United States Patent 8,178,340 (HUMAN SPECIFIC ESCHERICHIA COLI STRAINS) - sequence listing, part 2

SEQ ID NO: 7 - DNA, 5092707 bp, Escherichia coli (residues 1,697,570-3,395,138 of 5,092,707)
  misc_feature (1412423)..(1412522): n is a, c, g, or t
  misc_feature (1638195)..(1638294): n is a, c, g, or t
  misc_feature (1959934)..(1960387): n is a, c, g, or t
  misc_feature (2351498)..(2351597): n is a, c, g, or t
gcgcattccaggtcaattgtccactaactaacgccgtttcattgggctggctggtattacgacttaaaccttcaagttgcgcgtaaaagccgagcaactcccctttcaacgtataattcgggtcaagcggtatgcttttctcgagaatactttgtatctgattggaaacatctttctgtaccgatgcccccagagaatagcgactggtatcatcatgccaactggcggctaaaaaagaacgtgcgcgatgtttatcgtattttcccgtctggctgttataaaccccttcatcacgaataccggttgttgaatcggtccataaaaatactcgtgaacgccacattccccacagatcaatatttggcgttaaagcccaataacctaatgctccttcagaaacagtcggtaatgtacgttgcgaactgccagccattaacggaatacgataaggtaagctaccataactataatccgtcccgaagcgacctaattttagcaggctattttcactgggttttatttttactgcccccagggcaaagccaaaacttttatcaccatcaagataccaccgggtactcatatcagcacgagcacctaatttataaacataatacgccccgccttcaacgccaataatattggaataataaccactattgaaatcgagcaatcctccctgtacccatgcgtaaatatctcttcccgtgccagcactgggcttatcagccctgcgtaattcgtttttcagtctgatgcgtagtcccgcttcatcgtcagccggttgcgccgcgtaagcagaggtaaggccagaggcagccgtcaggcaaataacggccatggccactatttttctcatagttgcacctttgatgttctgattatttttattgaatattaactagtgatatcgttgattaattgctgctgaacttttttacgattatcaatttcaacaacgatttctttgaattttttatccgtgagcggataaaaccagataatgacgaatgccagtagcataaatccgcaaggtactaaggcaattgatgtgcggatgcccataataacttccggcgtttgcgcctgattggcgatatatccgcttaatcccaaaataaaggcaggaattgaacctccgattgcctgaccgcatttacgggtaaatgagaatagtgaataggtgagcccttcaattcgcacgccggtcaggtattcaccgtattctacggtatcagcttccagtgcccacatcacggtcatggtaacgccctggccaattgatgcgatggccaacgcaaccaacgccaccggcagtgaccagacagaaacccagaagaacagcagataaccgcaggttcccagcaaagcgccaatcaggaaggtattctttttaccgatcctcgcgaccatccccggcaccagcggtgccgatgccacagtaccgaccaggttttgcaccagtaccagcacagtgaacagcccggtatcatttaacacatagcgcacgtagaacaacgacgaggcgctgaccgcgaaggtcgaaatcagcacacacagcgcaccgatgcacaacataaacagcgggcgattccgtttcagggtttgcagactgatcttcaatgacggctgcgccacgatacgtaccacattctcacgcgtcgatttgaagcagatgaagtaaagcaccattccggcaatcgccagcacaattgtccagaaatgatataccgacaccatctcttccgggctggagttcttaatgctcggtcctatcagaaatgccaggcagacaaaagtcaatgaagcggcaatcccgcgagccgcgcccagacgggcgcgggattgtggttgttgggtcatcgcggtagcaagtgaaccataaggaatattcaccaggctgtagcaaagcccgagtcccatgtaggtcaaatatgcatacacaactttgctgctatggctccagtcggtcggcacccagaataccagcacgctgaagatcattaacggcgcagtaccaaagagtaaaaacgggcggaattttccccatcgggtattcacactgtccaccactcgtccggcaaagacatcggcgaaggcatcgaatacccgcaccagtaacagcatggtgcccgccgcagcggcaccgacgccagcgacgtcggtgtagtaactcaacaggaagagcgcccccattgcgaaggcgaagttattggcgacgtcaccgaggctgtagccgacgatggcgcgccaggagagttgttgattcattgtttgcctccctgctgcggtttttcaccgaagttcatgccggtccagcgtttttgcagcagaaaagccgcagacttcggtttgcggtcgcgagtgaagatccctttcttgttaccgccaacgcgcaatatgccttgcgaggtcgcaaaatcggcgaaattccatacctgctcaccgacgacagcgctgacgcgatcaaagacgcggtgatacatatccagccaggcgcactgatactcttcactccacatgtcggtgtacattgagtgcaggccggctaacgtatccacgccgtattcggtgatgataatcggctgatgcagtttctcctgccaggccagaagttctttttccagtaccttctctgccgtttccaaatcgccgctttggacataccaaccgtaataacggttcaggcacagcacatcaaagagatcgctgatggtatcggtgtgagcgtcgcagaacattacattgacacaggtgatcggacgcgtcgggtcgagtttacgcgttgcttccgccagtggcgcaaaatattcccgtgcaccttgcggacgggtatccggttcgttggcaatactccacatcaccacgcttgggtggtttttgtcacgcgcaatcagctctttaatcgcctgtaagtgcgcctgctgggtttccccgttgactgcctcttcgctgtacagttctttcggcttgttgcccgcttcgaaaccaatgcctaaagagaggttaaagccgacagctgcagtttcatcaatcaccacgatgccatgttcatctgcccagtcgagcatctcttcagcgtaagggtaatgcgaggtacggtaggagttggccccaatccagtccattaatgcgtgatcgtgcaccatcaacacgttatcgaatcctttgccgcgcaaatccgcatcttcatgacgaccaaagccagtaaagtagaacggtttgtggttgatcaggaactgttcgcccttcactgccactgaccggataccgacgcgcagcgggtagatatcacactctgtctggcttttggctgtgacgcacagttcatagagataaccttcacccggttgccagaggtgcggattcactacttgcaaagtcccgctggtgccttgtccagttgcaaccacctgttgatccgcatcacgcagttcaacgctgacatcaccatttgccaccacctgccagtcaacagatgcgtggttacagtcttgcgcgacatgcgtcaccacggtgatatcgtccaccctggtattcggcgtggtgtagagcattacgctgcgatggatcccggcgtagttaaagaaatcatgaaagtaagactgctttttcttgccgttttcgtcggtaatcaccattcccggcgggatagtctgccagttcagttcgttgttcacacaaacagtgatacgtacacttttcccggcaataacatacggagtgacatcggcttcaaatggcgtatagccgccctgatgctccatcacttcctgattatttacccacactttgccgtaatgagtgaccgcatcgaaacgcagtacaatacgctggcccgcccaacctttcggtataaagacttcgcgctgataccagacgttgcccacataattacgaatatctgcatcggcgaactgatcgttaaaactgcccggcacagcaattgcccggctttcttgtaacgcgctttcccaccaacgctgatcaattccacagttttcgcgatccagactgaatgcccacaggccgtcgagttttttgatttcacgggttggggtttctacaggacgtaacataagggactcctcattaagataaaaatactggtcaacctttaatcttattagttaaccaattctgtgttgcacacagttatctgtgagaaacccatggaagagaaatggaaataaaaagaactgacaccgcgatcaaaaaaccaaaaactgcaatacccacagcttgatattgatcgcattaatctttaaaacagcgttgacagaagccacaaaataagcaatcgaacgttcgctcgaacatattgggagcgataagccctcatgatatattgctacgatgaatatttaggtgggattctccgatccctgggaggatgatttttgcacagagaaattacgatatgaaacgcgggcacagttgtcaccagcccgcggaaagagagaggatcaggatgcggttaagataccgccaatcatcgcgcgtaaaccctgagcaaacgacgcttcacgcgccagatcttccgcttcgatatcggccagtacaccgtaggtcagatccagcagtaaacgtgaagtcattgccgtgttgatgtctgggcttatctcgcctttttgctgggcatcacgcatccgctgggcaacaaattccgtgatcgtcatatgcttatttttaagcatggcggcgacctgtgggttacgcatcccttccgccataatttcgaccaccagcgctcgttgcccaaagacttcatgggtgagagagacaatagactcgaccatatagtcaacgaaatgaatcccttcaatcggttcccggaaacgggccagcgccctctcctggtcctgtaagataatcgcctgaatcaaggcttctttggagatgaaatggtgatagagcgtcccgggactaatggcgcaggatttacagatggctttcatcgaggcactgtgaaatccattttctgaaaaaatctctctggcagcattgaggatccgggtccgtgtcggttgtgcttcagtctgcatgttatccatcattaaaccattatagttagcatgaataactagtttaccgcgttgtcaggtgagcgcctatcattgctgttgaatagtgcgaaggcacactcaattcgtaagctttttatccagatattggttaaccaatagccgtgatttggctgccagttgtttagcagagacgttgatgagttgcacacgctatcccggtaaacaacacatacggctgtttaccggttcgttagtgtattaattgagctcctgtaccccaccaccggagacggtgagaatttgtccgcttacccagctggctgcaggcgagcaaaggaacagcgccgcgttagctatatcttgcggttggcccagacgtctgattggtgtgtgttgcaacattttctgttcaatttctggtgtaataacggatttcagggcatcggttaatattgcccccggcgcaatgccattcacccgaatatttttttcacccaggtcaaacgccatatttctgaccagatgactggccgcagctttagatgatgcataggaggtcatgtttatatttttattttctgccgccatagaagtaatggtcagaataacaccaccgccatttttttccatttctggcgcaacaagttgtgacagatggaaaaaagaaaatacattcagttcataagcgcggcgaaaatctgccattggcatatcaaacggtttaggcccaccgctaccggcgttgttaaccaggatatcaactttacccaacttactgacggcaaagtctgccagtgcagagagttcctgttcggaagtaatatcgcagcggcaggcaaatgcctgaccacccagttgttgaatttcatttacaacatgattagctgcatcggcgttaatatcactgaccaccacagatgcgccagctgtcgcgaatgtaatggcgatttctttaccaatacctgcacccgcacctgtgatgatggcgcattttccgtcgagtctcaggttgtcagaattaaacacataaacctcctgtgaacttcagtaaaaataaaaggcaccgcctgtgtgccacattttttatcattaaccttgaggaaaggacactaccaggtatagcagataaagagaggattatttctccgcaatgagccgggcgggaataataagattgcgagaatgcgtctcttcatgggtgattttttgcatcatgcgatccgcaagtgtggtaccaagttcccgcgctggcgtgctggcccaggtaacgggtatatcatcaagtgtggttggcgttgcatcggtaaatgccgccagcgaaacctgttgctcaaagtaacgatcgactccgctttccccgctttgccttcctgctttcagcaaaccaaaccatgcccccatcgcaatagtttcgttatagcaaaccacggcgctgatggtcgggttatgacgtaaaagcgccgtgatagcttccgcggcttgcttctggctggaagtgcactccagcacccaatcgctgtgaaacggcaggccaaattttagtagagtcgcacaatagccccccacccgttctgcccgggttaatgaggaactttgccctcccagccaggcgatacgctgatgcccattgcgaatgagatgctccgtcaacaactgtgcagcctgcatgttgtccgggcgaaccgtatcaacgtcatcaagataactggcacgggaagcgaaaatcaccgggatagctttttcttctgctatccgtcgcaggtcatcgctgcttcctgcagccccggcaatgaccacaccatcgacaccctgattcagtaatagtgaaaaccgctgtgccagctgctcgccgtctttaccgccgtgaagcaaaaaaaccatccgtccctgcgcttccagagcttccgtcaatccggccgtcaattcggcgtaaaacggcgcagataaatcacggacgatcaaaccaatgacgccgctttgcccgccgcgcagcgccgacgcctggcgattgcgcacaaatcccagctcttcaatggcggcgttaacgcgttctcctgtggcggtagagattcgccctttgccactaagcaccagcgaaacggtacttaccgacacgcccgcagccagcgcaacatcatgaatggttatttttttggcggtagccatgcagatgacctactccctgattatgtgacagataaaacgttttaccttttatttatcttatacccgctattatcgttgtgtaatgtgatttatgcctcactaaaatttgataaaacgttttatcttctcgcgcaatttattgaatccagattgttctctacgaggagtcgttttatgacggcgaaaacagcaccgaaagtcacgctgtgggagttcttccagcagttaggcaaaaccttcatgttacccgtggcattattgtcgttctgcggcattatgctcggcattggtagttctcttagcagccatgatgtcatcaccctgatcccggtcctgggcaaccccgtgttgcaggctatctttacctggatgagtaagattggctcgtttgcttttagtttcctgccagtcatgttctgtatcgccatcccgctgggtctggcacgcgaaaacaaaggcgtagcggcattcgctggcttcgtcggttatgcggtaatgaacctcgcggtaaacttctggttgaccaataaaggcattctgccaaccacggacgccgcggttctgaaagccaataacatccagagcattcttgggatccagtcgatcgacaccgggatcctcggtgcggtgatcgccggtattatcgtctggatgctgcatgagcgattccataatatccgcctgccggatgcgctggcattcttcggcggtacgcgcttcgtaccaatcatctcctcgctagtgatgggtcttgtcggcctggtgattccattagtctggccgattttcgccatgggtattagcggcttaggccatatgatcaacagcgcgggagatttcggaccgatgctgtttggtaccggtgaacgtctgctgttgccgtttggtctgcatcacattctggtggcattaattcgctttaccgacgcaggcggcacgcaggaagtctgcggtcaaaccgtcagcggtgcactgaccatcttccaggcgcaattgagttgcccaaccactcacggtttttctgaaagcgccacgcgtttcctttcgcaaggtaaaatgcctgcgtttctcggcggtctgccaggtgcagcgttagctatgtatcactgtgcgcgcccggaaaatcgccataaaattaaaggtctgctgatttctggcctgatcgcctgtgtcgttggcggcacgaccgaaccgctggaattcctgttcctgttcgtagcgccagttctgtatgtcatccacgcgctgttaaccggcctcggcttcactgtcatgtctgtgctcggcgtcaccatcggtaataccgacggcaatatcatcgactttgtggtgttcggtattttgcatggtctgtcaaccaagtggtacatggtgccagtagtggcggcaatctggtttgtcgtttactacatcatcttccgtttcgctatcacccgcttcaatctcaaaaccccggggcgcgatagtgaagttgccagttcaatcgaaaaagccgttgccggtgcgccgggtaaatcaggttacaacgttccggcaatcctcgaagccttaggcggtgccgacaatattgtcagtctcgataactgcattacgcgtctgcgtttgtctgtaaaagatatgtcgcttgttaatgtgcaggcactgaaggacaatcgggcaattggcgtagtacaacttaatcaacataacctgcaggttgttatcgggccacaagttcagtcagtaaaagatgaaatggtcggtctgatgcgtactgtccaggcataaggataagatatgttcgatttttcaaaggtcgtggatcgtcatggcacatggtgtacgcagtgggattatgtcgctgaccgtttcggcactgctgacctgttaccgttcacgatttcagacatggattttgccactgccccctgcattatcgaggcgctgaatcagcgcctgatacacggcgtgtttggctacagccgctggaaaaacgatgagtttctcgcggctattgcccactggttttccacccagcattacaccgccatcgatcctcagtcggtggtgtatggcccttctgttatctatatggtttcagaactgattcgtcagtggtctgaaacaggtgaaggcgtggtgatccacacacccgcctatgacgcattttacaaggccattgaaggtaaccagcgcacagtaatgcccgttgctttagagaagcaggctgacggctggttttgcgatatgggcaagctggaagccgtgctggcgaaaccagaatgtaaaattatgctcctgtgtagcccacagaatcctaccgggaaagtgtggacgtgcgatgagctggagatcatggctgacctgtgcgagcgtcatggtgtgcgggttatttccgatgaaatccatatggatatggtttggggcgagcagccgcatattccctggagtaatgtggcgcgcggagactgggcgttgctaacgtcgggatcaaaaagtttcaatattcccgccctgaccggtgcttacgggattatagaaaatagcagtagccgcgatgcctatttatcggcactgaaaggacgtgatgggctttcttccccttcggtactggcgttaactgctcatatcgccgcctatcagcaaggcgcgccatggctggatgccttacgcgtctatctgaaagataacctgacgtatatcgcagataaaatgaacgctgcgtttcctgaactcaactggcagatcccgcaatccacttatctggcctggcttgatctacgtccgttgaatattgatgacaacgcgttgcaaaaagcgcttatcgagcaagaaaagatcgcgatcatgccgggatatacctacggtgaagaaggtcgtggttttgtccgactcaatgccggctgcccacgttcgaaactggaaaaaggtgtggctggattaattaacgccatccgcgctgttggttaaccccaattgcgcaacgtaaaaaatcgttgcgcaatcgtggatttttaccctgctttgtttttataatggtgcgcacttttatatccagaaaaagagtgcgaccatgattgataccaccctgccattaactgatatccatcgccaccttgatggcaacattcgtccccagaccattcttgaacttggccgccagtataatatcttgcttcctgcacaatccctggaaacactgattccccacgttcaggtcattgccaacgaacccgatctggtgagctttctgactaaacttgactggggcgttaaagttctcgcctctcttgatgcctgccgccgcgtggcatttgaaaacattgaagatgcagcccgtaacggcctgcactatgtcgagctgcatttttcaccaggctacatggcaatggcacatcagctgcctgtagcgggtgttgtcgaagcggtgatcgatggcgtacgtgaaggttgccgcacctttggtgtgcaggcgaagcttatcggtattatgagccggaccttcggcgaagccgcctgtcagcaagagctggaggcctttttagcccaccgtgaccagattaccgcacttgatttagccggtgataaacttggtttcccgggaagtctgttcctttctcatttcaaccgcgcgcgtgatgcgggctggcatattaccgtccatgcaggcgaagctgccggaccggaaagcatctggcaggcgattcgtgaactgggggcggagcgtattggacatggcgtaaaagccattgaagatcgggcgctgatggattttctcgccgagcaacaaattggtattgaatcctgtctgacctccaatattcagaccagcaccgtggcggatctggctgcacatccgctgaaaacgttccttgagcatggcattcgtgccagcattaacactgacgatccaggcgtgcagggagtggatatcattcacgaatataccgttgccgcgccagctgctgggttatcccgcgagcaaatccgccaggcacagattaatggtctggaaatggctttcctcagcgcagaggaaaaacgcgcactgcgagaaaaagtcgccgcgaagtaacaaaaatggatggtgctaattgcaccatccccttttcacgcaaggcacaaagtcgcgcgatgtttggcggattcgatgcccagctcaatcaactccattacctggattgcctgacttgccggaaccggattttcaccatcgccatttaacgcatcacgaatagccgcatagtaagccggataattccccggcaccgtcaacagcgtttcttcgacacgttcctcaccttccacgcgggtaagtacgccatcacgcatatcgtagccccagtcttcctgcggcagacgctcgccatttttcagacgttcttcctgtggatcgaggccatatttcacataactgcctcgggatccatgcacgatataacgtgctgactcagcagctgccagcattgtaccgtgtaaaatgactcgccgctgcggataggacaagatggcgtggaaataatcggtcgactgcgctccgggccgtaactgtgccaaatcaaccgtcatgctgaccggtaaaccaaatagcgtaatggcctgatcaagaagatgcggtgctaaatcgtaccagataccgctgccaggaccgccctgttcacgccaacgatcgcgcacctgcggacggaagcggtcaaaatgagactcaaagtaagcaacttcaccaagtacgccttccgcgagcaaaccttttagcgtcaggaaatcgctatcccagcgacggttatggaatacagacagcacacgccccaggctttttgccagcgcttccagctcgcgcgcttgtgacagtgtcacggtaaagggtttatcaacgaccacatgtttacccgcctcaagcgccgctttggctaacgggaaatgggtatcgttgggtgtaggaatgacaatcaggtctatgttgggatcgttaaacagatgcttcggctcagagacaaccgtaaccgttggccagtcggcttttacttttgtttcatcactgctggagattaccgccagttccagcccgggcgtgcccgcaatcagtggcgcatggaaggttttgctcgcataaccatacccaatcaacccaacacggatgttgtcgctcatgtcattgcctctcattgaagtataatggctatttgacactatcctttaccctcgctcaacagtttaataacctgccagcaataagggatgttgtttaacttaagtcaaaaaaatagcgatttttccaacgacaaaagctaaatatcgcaaaaacctcagtaaaaatcttgctggagctattattgctaagtaacatttaccccctgaagttaatggatcaatcaacagagatgtgggctgtaatgaatcgtcttattgaattaacaggttggatcgttcttgtcgtttcagtcattcttcttggcgtggcgagtcacattgacaactatcagccacctgaacagagtactacggttcaacacaagtaagctctgcgcttgtagagcgacatgctgcccgtccgggtgcatgttttcacttgtcggatattaaaccaggaatttattatcttgttcgatgttgttggtgattgtcagggatagtaaagcgcgttactcttttcagagcagtttttcatctctgaattatttgccatcagcgcattcttattattgtaataacacacgcgttcacttttggtgaaattttatcatcactaataatacctactcctttggtattaattattttatggaccttttatgactgttcaggactacttattaaaatttcgcaaaatcagttcactcgaaagtctggaaaaactctacgaccatcttaattacactctgacggatgatcaggaactgatcaatatgtatcgtgctgccgatcaccgccgcgcagagctggtttctggcgggcgtttgtttgacctcggccaggtaccgaagtccgtctggcactatgtccagtaaagaaagtagcgatcggttataaaagccttataataacgcccctaaaattagatttgtctgtttgcgtcgctattctggagaacctatgaccaccacaacgccacaacgtattggaggctggttgcttggcccgttggcctggcttttagtcgctctgttgagtacgacgctggcattgttgctgtataccgctgcgttatcttctccgcaaacatttcaaacgctcggcggacaagcactgacgacacaaatcttatggggcgtttcttttattaccgctatcgccatgtggtattacacactgtggttgaccatcgctttctttaaacgtcggcgttgtgttcctaaacactatattatctggctgcttatttccgtattgctggcagtaaaagcgttcgctttttcacccgtagaagatggcatagccgttcgccagttgctgtttactttgttggcaaccgcattgatcgtcccctatttcaaacgctcgtcgcgggtgaaagcgacgtttgtgaatccgtaataaccttacagttaacctgttgtcgcctgctctggattaacggataataagcggcttttttatttcaggccgaaaaatgactgactacctgttactgtttgtcggaactgtactggtcaataactttgtactggtcaagtttctcggtctctgtccgtttatgggggtttccaaaaagctggaaaccgcgatgggcatggggctggcaacaacgtttgtgatgacgctggcgtctatttgcgcctggcttatcgatacgtggattttgatcccacttaatctgatttacctgcgcaccctggcgtttattctggtgattgctgtggttgtgcagttcaccgaaatggtggtgcgcaaaaccagcccggtactttaccgtctgctggggatttttttgccgcttatcaccaccaactgtgccgtgctcggcgtggcgttgctgaatatcaatctcgggcacaatttcttgcagtcagcgctgtacggtttttccgccgctgtcggtttctcgctggtgatggtgctcttcgccgccatccgcgaacgccttgctgtggctgatgtcccggcaccttttcgcggtaatgccattgcgttaattaccgcaggtcttatgtctctggcctttatgggctttagtggtttggtgaagttgtaatgaatgctatctggattgccgttgccgccgtgagcctgctggccctggcgtttggcgccattctgggttatgcctcccgccgttttgcggtggaagacgatccggtcgttgagaaaattgacgaaatcttaccgcagagccagtgtggtcagtgcggttatcccggctgtcgcccctacgcggaagccatcagctgtaacggtgaaaaaatcaaccgttgcgccccaggtggcgaagctgtgatgctaaaaattgccgagttgcttaatgtcgagccgcagccgctggatggcgaagcgcaagagctaacgccagcgcggatggtggcggttattgatgaaaataactgtattggctgcactaaatgtattcaggcgtgtccggtagacgccatcgttggcgctacccgcgccatgcatacggtaatgagtgatctctgtacgggctgcaatttatgtgttgatccgtgcccgacacactgcatctcgttgcaaccggtcgcagaaactcctgactcctggaaatgggatctgaacaccattcccgtgcgtatcattcccgtggaacaccatgcttaagttattctctgcattcagaaaaaataaaatctgggatttcaacggcggcatccatccaccggagatgaaaacccagtccaacggtacgcccctgcgccaggtaccactggcgcagcgttttgtcattccactgaaacaacatattggcgctgaaggtgagttgtgcgttagcgtcggcgataaagtattgcgcggccagccgcttacccgtggtcgcggcaaaatgctgccggttcacgcgcccacctcgggtaccgttacggctattgcgccccactctacggctcatccttcagctttagctgaattaagtgtgattattgatgccgatggcgaagactgctggatcccgcgcgacggctgggccgattatcgctctcgcagtcgcgaagagttaatcgagcgcattcatcagtttggtgttgccgggctgggtggtgcgggatttccgacaggcgttaaattgcagggcggcggagataagattgaaacgttgattatcaacgctgctgagtgcgagccgtatattaccgccgatgaccgtttgatgcaggattgtgcggctcaggtcgtagagggtatccgcatccttgcgcatattctgcagccacgcgaaattcttatcggtattgaagataacaaaccgcaggcgatttccatgctgcgtgcggtgctggcagactctcacgatatttctctgcgggtgattcccaccaaatatccttctggcggtgctaaacaattaacctacattctgaccgggaagcaggttccacatggcgggcgttcatccgatatcggcgtattaatgcaaaacgtcggcaccgcttatgcagtgaaacgtgccgttattgatggcgagccgattaccgagcgtgtcgtgaccctgactggcgaagcaatcgctcgcccgggcaacgtctgggcacggctgggtacgccagtgcgtcatttattgaatgatgccggattctgcccctctgccgatcaaatggtgattatgggcggcccgctaatgggctttaccttgccgtggctggatgtcccggtcgtaaagattaccaactgtcttttggctccctctgccaatgaacttggcgaaccacaggaagaacaaagttgcatccgttgtagcgcctgtgctgacgcctgccctgcggatcttttgccgcaacagctgtactggttcagcaaaggtcagcaacacgataaagccaccacgcataacattgccgactgcattgaatgtggagcttgcgcgtgggtttgcccgagcaatatccccctggtgcaatatttccgtcaggaaaaagctgaaattgcggctattcgtcaggaagaaaagcgcgccgcagaagccaaagcgcgtttcgaagcgcgccaggctcgtctggagcgcgaaaaagcggctcgccttgaacgacataagagcgcagccgttcaacctgcagccaaagataaagatgcgattgctgccgctctggcgcgggtgaaagagaaacaggcccaggctacacagcctattgtgattaaagcgggcgaacgcccggataacagtgcaattattgcagcacgggaagcccgtaaagcgcaagccagagcgaaacaggcagaactgcagcaaactaacgacgctgcaaccgttgctgatccacgtaaaactgcagttgaagcggctattgcccgcgccaaagcacgtaagctggaacagcaacaggctaatgcggagccagaagaacagattgatccgcgcaaagccgccgtcgaagcggctattgcccgtgccaaagcacgcaagctggaacagcaacaggctaatgcggagccagaagaacagattgatccgcgcaaagccgccgtcgaagcggctattgcccgtgccaaagcacgcaagctggaacagcaacaggctaatgcggagccagaagaacagattgatccgcgcaaagctgccgtcgaagcggctattgcccgtgccaaagcacgcaagctggaacagcaacaggctaatgcagagccagaagaacagattgatccgcgcaaagcggcagttgctgcggctattgcccgcgttcaggccaaaaaagccgcccagcaaaaggttgtaaacgaggactaaatggtattcagaatagctagctccccttatacccataaccagcgccagacatcgcgcattatgctgttggtattgctcgcagccgtgccaggaatcgcagcgcaactgtggttttttggttggggtactctcgttcagatcctgttggcgtcggtcagtgctcttctggccgaagctctcgtcctcaaactacgcaagcagtcggtagctgcaacgttgaaagataactcagcattgctgacaggcttattgctggcggtaagtattccccctctcgcgccatggtggatggtcgtgctgggtacggtgtttgcggtgatcatcgctaaacagttgtatggcggtctggggcaaaacccgtttaatccggcaatgattggttatgtggtcttactgatctccttcccggtgcagatgaccagttggttaccgccacatgaaattgcggtcaacatccctggttttatcgacgccatacaggttattttcagtggtcataccaccagtggtggtgatatgaacacgctacgcttaggtattgatggcattagtcaggcgacaccgctggatacatttaaaacctctgtccgtgccggtcattcggttgaagagattatgcaatatccgatctacagcggtattctggcgggcgctggttggcaatgggtaaatctcgcctggctggctggcggcgtgtggttgctatggcagaaagcgattcgctggcatattcccctcagcttcttagtaacgctggcgttatgcgcaacgttgggctggttgttctcaccagatactctggcagcaccgcaaattcatctgctgtctggtgcgaccatgctcggcgcattctttattttgactgacccggttaccgcttctacgaccaatcgtggtcgtcttattttcggcgcgctggcgggcttattagtctggatgatccgcagtttcggcggctatcctgacggcgtggcttttgccgtcctgctggcgaacatcacggttcctctgatcgattactacacgcgtccgcgcgtctacggccatcgcaaagggtaaaccatgctgaaaactatccgaaaacacggcattacgttggcgctctttgcagcgggttcaacagggttaactgcggccatcaaccagatgaccaaaacgacaattgctgaacaggccagtctgcaacaaaaggcgttatttgatcaggtgctgccagctgaacgctataacaatgcgctggcacagagttgctatctggtaactgcgccagagttaggtaaaggtgagcatcgggtttacatcgccaaacaggatgacaaaccggtagccgccgttctggaagcaaccgcgccagatggctattccggtgcgattcagctgctggtgggagccgattttaacggcacggtacttggcacgcgcgtgactgagcaccacgaaacgccagggcttggcgataaaatcgaactgcgcctttctgactggatcacccattttgcgggtaaaaaaatcggtggtgcggatgatgcgaactgggcggtgaagaaagatggtggtgatttcgaccagttcaccggcgcgacgattactccccgcgcggtggttaatgcggtaaaacgcgccggattgtacgctcagacgttaccggcacaactttctcaacttcctgcctgtggagaataaaacgtgagcgaaattaaagacgttattgttcaggggttgtggaaaaacaactctgcgctggtccagttgctcggcctttgtccgctgttggcggtcacgtccactgccactaacgctctgggtttaggacttgcgactacgctggtactgacgctaaccaacctgaccatttcgacgctgcgtcactggacgcccgccgagatccgcattcccatttacgtgatgatcatcgcctcggtggtcagcgctgtacagatgctgatcaacgcctacgcctttggcctgtatcaatcattagggatttttattccgctgattgtcactaactgtatcgttgtgggccgcgctgaagccttcgccgccaaaaaaggtccggcgctttcggcactggacggcttttcaattggtatgggcgcaacctgcgccatgttcgtgctgggttcactacgcgaaattatcggcaatggcacgttgtttgacggtgcagatgcgctgttaggtagctgggcaaaagtattacgcgtggagattttccacaccgactcccctttcctgctggcgatgctgccaccaggtgcatttattggcctgggactgatgctggcaggaaaatacctgattgatgaaaaaatgaaaaagcgccgtactgaagcagctgccgaacgtgcattgccaaacggtgaaacagggaatgtctgatgaacaaagcaaaacgcctggagatcctcactcgcctgcgtgagaacaatcctcatcccaccaccgagcttaatttcagttcgccttttgaattgctgattgccgtactgctttccgctcaggcgaccgatgtcagtgttaataaggcgacggcgaaactctacccggtggctaatacgcctgcagcgatgcttgaactgggcgttgaaggggtgaaaacctatatcaaaacgattggcctttataacagcaaagcagaaaatatcatcaaaacctgccgtatattactggaacaacataatggcgaggttccggaagatcgtgctgcgcttgaagccctgcctggtgtaggtcgtaaaacagccaacgtcgtattaaacactgcattcggctggccgactattgctgtcgacacacacattttccgcgtttgtaatcgtacacaatttgcgccggggaaaaacgtcgaacaggtagaagaaaagctactgaaagtggttccggcagagtttaaagtcgactgccaccattggttgatcctgcacgggcgttatacctgcattgcccgcaagcctcgctgtggctcttgtattattgaagatctttgtgaatacaaagagaaagttgacatctaaagatcaggggtaacaccgattaccctattcataacctttctttatcctcttttaaaacatctttttaacgtcaatgatgccattgcttagcgttatcatcaggtaatccgtttgcagataaccaaaaatgcaggttaattgtttttttaatagcgaaattttctattcattcgtgatcaagatcacgatgctgtggcaatgtaaaaacattgcaataatcaggttaaaatcatttaaatttacacacgcaacaaatattgacctacaaaacattacactggctatttttcagaaactggactatctcactaggaaaaacgccaaatagtagaacatatcgccattaccccatcatcaccctctcagggtagtgaaaaaatctgccgttacgttttttgaaaaatttaacgctggataacatttcccggaatggttgaattccccgcctcagttatatgtaacagattattacaaaggacttgtctgaaagtgcaagatagtgaacattacctgccgtttcccctcccactataacaattgcgcgtatgttttttagacataacgcgagaaagcacccccgttaatatgggatgtaaaaaaagaggtaaaagtgtccactgcaaaccaaaaaccaactgaaagcgtcagtttaaacgcttttaaacaaccgaaggcgttctatctcatcttctcgattgagttatgggaacgttttggttattacggcctacaaggaattatggctgtttacctggttaaacaactgggtatgtctgaagcggattcaatcacccttttctcttcctttagtgccctggtttatggtctggtcgctatcggcggctggttaggtgacaaggtactgggtactaaacgcgtaattatgctcggcgctattgtgctggcgattggttatgctctggttgcctggtctggtcacgacgccggtatcgtttatatgggtatggcggctattgcggtcggtaacggcctgtttaaagctaacccgtcttctctgctttctacatgctatgagaaaaacgacccgcgtctggacggtgcattcaccatgtactacatgtccgtcaacatcggctctttcttctctatgattgctacgccgtggctggccgcgaaatacggctggagtgttgcgtttgcgttgagcgttgtaggcctgctgatcactatcgttaacttcgccttctgccaacgttgggttaaacagtacggttcaaaaccagacttcgagcctatcaactaccgtaacctgctgctgaccattattggtgttgtggcactgatcgctatcgccacctggctgctgcacaatcaggaagttgcgcgtatggcgctgggcgttgttgccttcggtatcgtggttatcttcggtaaagaagccttcgcgatgaaaggtgctgcgcgtcgtaaaatgatcgttgccttcatcctgatgctcgaagccattatcttcttcgtgctttatagccagatgccaacgtcactgaacttctttgcgattcgtaacgttgaacacaccattctgggcctggccgtagaacctgagcagtatcaggcactgaacccgttctggatcatcattggtagcccgattctggccgctatctataacaagatgggcgataccctgccaatgccaaccaagtttgctatcggcatggtgatgtgttctggtgcgttcctgattctgccgctgggtgcgaaattcgcgtctgacgctggtatcgtgtctgtaagctggctggtcgcgagctatggcctgcagagtatcggggaactgatgatctctggcctgggtctggcaatggttgcacaactcgttccgcagcgtctgatgggcttcattatgggtagctggttcctgaccactgccggtgcaaacctgattggtggttatgttgcaggtatgatggctgtgccggataacgttaccgatccgctgatgtcactggaagtctatggtcgcgtattcttgcagattggtgtcgctactgccgttattgcagtactgatgctgtttaccgcgccgaaactgcaccgcatgacgcaggatgacgctgcagacaaagcggcgaaagcagccgtagcgtaaaattcagggaaactcttttacaagccgctaacttttcgttagcggctttttttttgttcagcaacgcactaccatactttaaaccacagacaaaaggagttaccgatgaaattgttctacaaaccgggcgcctgctctctcgcttcccatatcaccctgcgtgagagcggaaaggattttacgctcgtcagtgtggatttaatgaaaaaacgtctcgaaaacggtgacgattactttgccgttaaccctaagggacaggtacctgcattgctgctggatgatggtactttgctgacggaaggcgtagcgattatgcagtatcttgccgacagcgtccccgaccgccagttgctggcaccggtaaacagtatttcccgctataaaaccatcgaatggctgaattacatcgccaccgagctgcataaaggtttcacacctctgtttcgccctgatacaccggaagagtacaaatcgacagttcgcgcgcagctggagaagaagctgcaatatgtgaacgaggcactgaaggatgagcactggatctgcgggcaacgatttacaattgctgatgcctatctgtttacggttctgcgctgggcatacgcggtgaaactgaatctggaagggttagagcacattgcggcatttatgcaacgtatggctgaacgtccggaagtacaagacgcgctgtcagcggaaggcttaaagtaatagccatcggcccacaggtcgttgtgggccgaaatgagatatttcagagctttgttgcgctgaaataatgttctggattggcaatacgatcctgagcagcaaccacttgcagctcatattcctgcattgcttttgtggtcaccatgatttcgtatactgcagcggtcacatgttccagggcctcctgcagcgttgccccctgaagcagtttcaccagcagtaagccgctcgtcacatcaccaacacctaccggctggcgcataccaaaatccaccagcggacggctgatatgccaggcttcatcggcggtgactagcagcatttcaaaacggtcacggctgtagccagctcgcgccaggtgtttaaccaacacaatttgtggcccttgcgcaatgagttcgcgcgctgccagaaccgcttcttcgacgttatttaccggatgctcacagagtatttccagctcaaccagattcggcgcaatgatatcgctggcaggcaaaccgtgccgcacatgaaactctgcgacacccggtgcaacgatacagcctttttccggatgacccattaccggatcgcaaaaatatttcgcctgtggattcgctgctttcacctgacgaacgataccgaggatatgttcaccctgctccgccgatcccagatagccacttaatacggcatcacaggtgtgtaatttatcaatggcggcaatgccttgcacaatttcggttaaatggctgggcggcatcacgcagccagtccatttgccgtattgggtgtgattagaaaattgaacggtgttcagcggccagacgttcgcgcccaggcggcgcatcggaaactctgccgcactgttacccgcatgaccataaacaacgtgagactggatagcgagaatatttttcatcatgctccctgtataaaaaccagggggagtgatttctcactccccctttccacttaatgcattatttccagcaaatcagacagtaattctttttgccgcgacgcagcaaggtaaaacgaccaaacagacgatcttcttctttaaagaaatattcaggatcggactgtttttcaccgttaatggtgatggcattggaggcgatagttttacgcgcctgaccacgggaaggttgcagttcagaatcgaccagcgcctgcatcaggtctgcgcccttttccatctcaaccatcggtacgccgtcctgcgccagctgttcgaagtccgcttcactcagcgcactcaaggaaccgctgaacaggcattcggtaatacgttttgccgcctgcaaaccgtcttcaccatgcaccagacgtgtcacctgttctgcaagcacatactgggcgcgcggtgctttaccgctgtttttatcttcttcttccagggcgttgatctcttcaatgctcatgaaggtgaagaacttcaggaagcggtaaacgtcggcatccgcagtgttgatccagaactggtagaatttgtacgggctggttttcttcggatccaaccagactgcgccgccttcagttttaccaaatttggtgccgtctgctttggtgatcagcggaacggtcaagccaaacacctgattctgatgcagacgacgggtcaggtcgataccagaagtgatgttaccccactggtcagaaccaccgatttgcagcaccacaccgtactgtttgttcagacaggcgaagtcataaccctgcaacaggttgtaggaaaactcagtgaacgaaatcccctgatcttcacggttgagacgctgcttaaccgcttctttgttgatcatctggttaacggagaagtgtttgccaatatcgcgcaggaaggtcagcacattcatattgccgaaccagtcatagttgttcgccgcgatagcagagttttctccacagtcgaaatcgaggaacggggcaacctgcttgcggattttgtccacccactcctgaacagtttcttcagtgttcagcttacgctcggcagctttgaagctcgggtcgccaatcagacccgtcgcgccgcctaccagcgcaaccggcttgtggcccgcctgctggaagcgtttcaggcataacaatggaacaagatgccccaaatgcaagctgtcagcggtaggatcgaagccgcaatagagcgcgatcgggccttgcgccagtcgctctgctaacgcttcctcgtccgtcacctgggctaccagcccccgctcttgcaattgtttaatcaagttactgcttgccatcaaaatctccatgtatataacgactgcacctttgccggtacacgacttttcgccagatgcgaaagagacatagaataaagtgccagaatcaggagtaccagcgattaaagcaagatttttgcatcttttcagggtgcaagacgatcaatcttccacgcatcattttcacgctggtacaaaaagcggtcatgcaggcgatgctcaccgccctgccagaactcaatctgttcaaggctgacgcgaaaaccgccccaaaaacttggcaatggcacttcgccctgttgaaacttctgcttcagctccaggaatttactttcaaggataccgcgggcagaaatgcgactggactgcttcgaaacccatgccccaatctggctatcacgcgggcggctatgaaaatatttcatcacttcgagagtcgaaagtcgttccgctttaccgatcaccatcacctggcgttcaagggtatgccacgggaacagcaggctaacgcgcggattattttcgatttgatgtgctttacggctgccgaggttggtgtaaaacaccatgcctttttcgtcgtaatgtttgagtaaaacgatgcgctgataaggctgatcatgttcatccacggtagcgaccaccatcgcggtagggtcagccagtttggcttcacaagcctgagagagccaacgttcaaaaagggttaatggatcggcgggtagatcgcggcggcgtaacccgcctttggtgtattcacggcgcagatgcgcgatttgctgcaattcgtcgttatcagacatggttttctttacggattgtcagtgggtgacgctattgtgcgccgcccctggaaaaatctcaacgctgcggattttgtaactgacagttattcaagacgatgcggtcgcgtttatagacagtcgcttcctcgcctttcgaccagaaaacatagattccgtcggtgtaacgtgcaccagacgctgaaatgccctgtttgagatgcagtagttgattatcgtaaacaaaactgacttcctggcgcggattattcagtttgaccgtcaacggtttttcatcacactggtattccagcgtatcggtttgcatgcgctcaaccagttgattgaacgcgctacagccggtgagaagcaccggcaaacagatcagtaacagttttttcatagacatatcccgaagactttcctggtctggagggcaatacgccctccctaacgttccaagtgtaacggcagacgcggtaagaaaaattcagttaactctgatatcacgggttagcggggaaaatagcccccagtaccgtctcctggcttgcgccagtgacggaaggcagatttcctggtaatcccgccagcgttcgccaggcaagccaggcgaacgccaatgcttccatgtcatcgccactaatgccaacggcatcggtggtggtgacttctgtgcctggcagtaatgccgccagacgcgccatgagtagcggattacgactacctccaccacataccatcaatcgttcgcagccaccgctcaacaaaacttgttcagaaatggtcacggcggtgagttctgccagtgtggcctgcacatcacggggatcaacccccggaaaatggcgcaaatggcgctccagccagccgtagttaaagtattcgcgtccggtgcttttcggtgcgggttgcgagaaatatgggtcgcagagcatattttgcagcagtgggagaataactttacccgcccgtgcccactcggcatctttatcgtaaggtttaccggcctgacgccagatccaggcatccatcagcatgttaccaggaccggtatcgtagcccccaaccggctggccaggaatgagcagtgacagattggcgatgccgccaatattgagcaccattcgtcgctcggttgggtgagccagcagcgcatgatggaacgcaggtaccagcggtgcaccttgtcctcccaaggcaatatcgcgacggcgaaaatcaccgacaaccgtaattccggtgcgcgccacaatttgattgttatcgccaatctgtaaagtgtgtggtgccacgcccgtcggttcgtgccagacggtttgaccgtggcagccgatcgcaactatatctctcgcctgcaggttttgttccttaagcaaggcattgaccgcatcagcaaaaagtcgcccaagttgagtatcaagctgtccaaactgcgaaagtgtaagctgctggccctggcaaatatccagtacagcctgtttcagagacaccgggatcggccagctcaaacttgccagctgtgcgacccggtgttcatcaattgtcgccaacacaacatcaacaccatcaaggctggtgcctgacataacgccaataaagcggcccgatttcatagttcatcctttttcaatctgacgtttgcgcaccactcaaacataaacttttcgtgaataccatgcggaatgaccaatttttaccgttggtagtaaaacattatcttcaaatcaataatcatcatgaatattttgtttataattggttgatcctactttcattatgatttgctcatatttggtagaacatgtaaccatggattcacatatgccatatactttgaccatgagggatgcttgcgtggcgtttcatggtgaacaggagatttttcaatgattaaacgcgtattggttgtttcaatggtaggtctgtctcttgtcggttgtgttaataacgacaccctgtcaggggatgtttataccgcttctgaagcgaaacaagtacagaatgtcagctatggcaccatcgttaatgtacgtcaggtacagattcagggcggtgatgattccaacgttatcggcgcaattggtggtgctgtacttggtggtttcctgggaaatactattggcggcggaaccgggcgttctctggctactgcagcaggggctgttgcaggtggtgtagccggtcagggcgtacagagtgcaatgaacaaaacgcagggtgtcgagctggaaattcgtaaagatgatggcaacaccatcatggtggtacagaaacaagggaacactcatttctctccaggccaacgtgtcgtactggccagcaatggcagtcaggtgaccgtttccccgcgctaaataagtttgcgtgtggtcaggttactgaccacacgcccccttcatttcaccctttggcctgtaactcaatgatattatgctcaagttttgcgatgagcttaatcagttgttccagttcctctgcggagatgccatgtaaaatttccgcgcgggttttgttaataacggcttccatttcgctgatcagtggctctgccttttccgtcagtttaatacgtttagcccgacgatcgctggcacaagtttgacgtgaaattaaccctttttcttccagttggtccagcgtacggaccagtgatggctgctcgatgccaatcgcttttgccagttgaatttgcgactggtctggaggtaactgatggatattgtgtaacgtaacccaatgggtttgtgttaactccagcggtttcaggcgatggtctatcagagcacgccatatgcgcaccaaccgtgccagatcagaacctagtggcgattccaattttatctccttataattagcttgctaagatattatgcggcttttagaatagtgtgcagcaattgtattgctaaaacaaatgtattgctgcatttggttaccgtcagacatatttttcagaaattgcgcgtaaatttttcgcacttaaagaatatttattaatctaacgcaatatattctgtcgtaaaggaatctactttgtgaagtttatgctcaatgcaacaggattgcccttacaagatctggtgttcggtgcgtccgtctactttcctccgtttttcaaagccttcgcatttggattcgtcatctggcttgtcatacaccgcctgcttcgaggctggatctacgccggtgacatctggcatcccttgttaatggatttatcgctgtttgcgatttgcgtttgccttgctctggcaatactgattgcgtggtaactatgtcaattaaaacaattaagtatttctcaacaatcattgtagcggtagttgcggttcttgccggatggtggctgtggaatttttacatgcaatctccgtggacacgcgacgggaaaatacgcgcagaacaggtttctatcaccccacaggtgtcgggacgtattgttgagctgaatataaaagacaaccagctggttaacgcgggggatcttctgctcacgatcgataaaacgccctttcagatcgccgagctgaacgcacaggctcagctggcgaaagcgcaatctgacctcgcaaaagccaataacgaaacgaatcgtcgtcgtcatctctcacaaaattttatttctgccgaagaactcgataccgctaacctcaatgttaaagcgatgcaggccagcgttgatgccgcacaggcgacgctaaaacaggcacaatggcaactggcgcaaacggaaattcgcgccccggtgagtggatgggtgactaatctcactacccgcatcggcgactacgctgacaccgggaaaccgctgtttgcccttgtcgacagccactcgttttacgtcattggttattttgaagaaaccaagttgcgccatatccgcgaaggtgcaccagcacaaattaccctctatagtgataacaaaacgttacagggtcacgtgtccagtatcggtcgggcgatttatgatcagagcgttgaaagtgactcaagccttattccggatgtgaaacctaacgtcccctgggttcgcctcgcccaacgcgttcccgtccgctttacgctggataaagtcccaggcgatgtcacgctggtgtcgggcaccacctgtagcattgccgtaggtcaataatgaacgcatcgtcatggtccttgcgcaatttgccctggttcagggccacgctggcgcaatggcgttatgcgttacgcaataccattgccatgtgtctggcgctgacggttgcctattatttgaatcttgatgagccctattgggcgatgacctcggctgcggtggttagctttcccaccgttggcggtgtcatcagcaaaagcctcggacgcatcgctggcagtttgctcggagccattgcggcactgcttcttgccggacatacgctcaatgagccgtggttttttctattgagcatgtcggcgtggcttggcttttgtacctgggcctgtgcgcacttcacgaataacgtcgcgtatgcatttcaactggcgggctacacggctgccatcatcgcctttccgatggttaatattactgaggccagccagctgtgggatatcgctcaggcgcgtgtttgcgaggtgatagtcggtattttgtgcggcggcatgatgatgatgatcctgccgagcagttccgatgctacagcccttttaaccgcattgaaaaacatgcacgcccgattactggaacatgccagtttactctggcagcctgaaacaaccgatgccattcgtgctgcacatgaaggggtgattgggcagatactgaccatgaatttgctgcgtatccaggctttctggagccactatcgttttcgccagcaaaacgcacgccttaatgcgctgctccaccagcaattacgtatgaccagtgtcatctccagcctacgacgtatgttgctcaactggccctcaccgccagataccacgcgagaaattctcgaacagctgctgacggcgctcgccagttcgcaaacagatgtttacaccgtcgcacgtattatctccccgctacgcccgaccaacgtcgccgactaccggcacgtcgccttctggcagcgactacgttatttttgccgcctttatctgcaaagtagtcaggaattacatcgtctgcaaagcggtgtagatgatcatgccagactcccacggacatccggcctggctcgtcataccgataacgccgaagctatgtggagcgggctgcgtacattttgtacgttgatgatgattggcgcatggagtattgcttcgcaatgggatgccggtgccaatgctttaacgctggcagcaattagctgcgtactctactccgccgtcgcggcaccgtttaagtcgttgtcactgctgatgcgcacgctggtgttactttcgctattcagctttgtggtcaaatttggcctgatggtgcagattagcgatctgtggcaatttttactgtttctctttccactgctggcgacaatgcagcttcttaaatcgcagatgcccaaatttgccgcactgtgggggcaactgattgtttttatgggttcgtttatcgctgtcactaatcccccggtgtatgattttgctgattttcttaacgataatctggcaaaaattgttggcgtcgcgttggcgtggttagcgttcgccattctgcgtccaggatcggatgctcgtaaaagccgccgccatattcgcgcgctgcgccgggattttgtcgatcaactaagccgccatccaacactgagtgaaagcgaatttgaatcgctcacttatcatcacgtcagtcagttgagtaacagccaggatgcgctggctcgccgttggttattacgctggggtgtagtgttgctgaactgttctcatgttgtctggcaattgcgcgactgggaatcgcgttccgatccgttatcgcgagtacgggataactgtatttcactgttgcggggagtgatgagtgagcgtggcgttcagcaaaaatcactggcggccacacttgaagaattacagcggatttgcgacagccttgcccgtcatcatcaacctgccgcccgagagctggcggcaattgtctggcggctgtactgctcgctttcgcaacttgagcaagcaccgccgcaaggtacgctggcttcttaattacttaattacaccacaggcatagcgttcaccgccaccgcccagcggtttgggttgatcggacatattatcgccgccaacgtggaccatcagcgctttgtctttgacttcatccagtgatttcagacgaggcgcgatgacggcatcggtcgccttgccgtcattattgactaccagtgcaggcagatcgcctaaatgcccggcaccttctggcccttcatgtttaccggtattttgtggatcaagatgcccgcctgcggattctgcggcgctggctttgccatctttggtggctggctggcagcttcctttggcatgaatatggaagccatgttcaccgggaggtaatgctttcagatcgggcgaaaactccagacctttatcggtttcagtaatggtgacgctaccaattgactgcccaaccccttgcgacgtgacgaggttcatctcgactttttcactggcagcttgtgcgccggtcgcaacaaccagcgccagaatggccagactaaaacgtttcataggacctccgttcattgtgcattcctgaataagtgtaaacctgtgacacatttttgaacggcggctattcctaaaagtgcttacggtacgtcgtaacctagtgccgctttacggatacgaaaccattgttgacgggtcattttcagtgtttctgcttcgacagctgcccgtacgcgctcaattttacctgagccgataattggcagcggctgcgacggtaaacgtagtacccaggcgtaaactacctgttcaatcgagcccgcgtttaactcctctgccaccacagccagttcatcacgcagcggctggaaataatcatcattaaacagacgaccaccaccaaggcaggaccacgccatcggacgaatacgcagttgttgcagttggtcgagcgtgccatccagcagtaacggctgatgcaccggggatatttccacctgattagtggcaagagtaaatggcaggcgtgattgcaacagcgcaaattgcgcaggtgtaaagtttgatacaccaaaatgacgcactttgccgctctgatgcagatgtttaaaggcgtccgccacttcatcggcatccattaacgggtctggtcggtggattaacagcagatccagatgatcggtcgcgagattaattagcgactgttcggcgctcttaatgatgtgatcgcggtcagtgatgtaatggccaatgacgttttcttcacgcgcggtcgtcgcgataccgcatttactgacgatttccatccgttcacgcaggtgaggtgccagtttcaacgcctcgccaaacgccgcttcgcactgatagccaccataaatatcagcatggtccacggtggtcacgccgagatccagatgctcttcaataaaactgaccaactggcgggcggacatgttccagtccatcaatcgccagtagcccatcacaaaacgggaaaactccgggccttgcggcgcaatagtaatacgctgaaccataatcgcttcctcttatcagatatgagaggagtatacgcaagattaggctcaaaagagtgatggttgctccggttcgtctgatggcgctggcttatttacacgtaatttgcgcattaatcgctgccgacaaaggcgcaacacttcttgtttttcgccatcgctcatcttattccagttaaaacgctcatcccggctacgaaaacagccgcgacaaaatccccgttcgtcagactggcaaattccccggcacgggctctggacgggaaagaactctaattgctccgtcacctcgccctcctcagataagattattaccattattgaagctgttaatgtccaaagtagcaactttgcttgcactagaccgactggtctactacactccaacgcatgaacaaacacaccgaacatgatactcgcgaacatctcctggcgacgggcgagcaactttgcctgcaacgtggattcaccgggatggggctaagcgaactcctaaaaaccgctgaagtgccgaaagggtccttctatcactactttcgttctaaagaagcgtttggcgttgctatgcttgagcgccattacgccgcatatcaccagcgactgactgagttgctgcaatccggcgaaggtaactaccgcgaccgcatactggcttattaccagcaaacactgaaccagttttgccaacatggaaccatcagtggttgcctgacagtaaaactctctgccgaagtgtgcgatctgtcagaagatatgcgcagcgcaatggataaaggggctcgcggcgtgatcgccctgctctctcaggcgctggaaaatggccgtgagaaccattgtttaaccttttgtggcgaaccgctgcaacaggcacaagtgctttacgcactgtggcttggcgcgaatctgcaggccaaaatttcgcgcagtttcgagccactggaaaacgcgctggcccatgtaaaaaacattattgcgacgcctgccgtttagcaggcattttttatcaccagacgaccgggagcctttatgtcatctgaaaaactgtattccccactgaaagtgggcgcgatcacggcggcaaatcgtatttttatggcaccgctgacgcgtctgcgcagtattgaaccgggtgacatccctaccccgttgatggcggaatactatcgccaacgtgccagtgccggtttgattattagcgaagccacgcaaatttctgcccaggcaaaaggatacgcaggtgcacctggcatccatagccaggaacaaattgccgcatggaaaaaaattaccgctggcgttcatgctgaaaatggtcatatggccgtacagctgtggcacaccggacgcatttctcacgccagcctgcaacctggcggtcaggcaccggtagcgccttcagcacttagcgcgggaacacgtacttctctgcgcgatgaaaatggtcaggcgatccgtgttgaaacatccatgccgcgtgcgcttgaactgggagagattcagggtatcgtcaatgatttccgtcaggccattgctaacgcgcgtgaagccggttttgatctggtagagctccactctgctcacggttatttgctgcatcagttcctttccccttcttcaaaccatcgtaccgatcagtacggtggcagcgtggaaaatcgcgcgcgtctggtgctggaagtggtcgatgccgggattgaagaatggggtgccgatcgcattggcattcgcatttcgccaatcggtactttccagaacacggataacggcccgaatgaagaagccgatgcactgtatctgattgaacaactgggtaaacgcggcattgcttatcttcatatgtcagaaccagattgggcgggaggtgaaccatatactgatgcgtttcgcgaaaaagtacgcgcccgtttccacggtccgattatcggcgcaggtgcatacacagtagaaaaagctgaaacgctgatcggcaaagggttaattgatgcggtagcatttggtcgtgactggattgcgaacccggatctggtcgcccgcttgcagcgcaaagctgagcttaacccgcagcgtgccgaaagtttttatggtggcggtgctgaaggttacactgattacccgacgctgtaatccaacattgcgagcggcgcaaagccgccgctatactaaaacaactttttgaatctgttagccattttgaggatataaagatgcgtcttcttcataccatgctgcgcgttggcgatctgcaacgctccatcgatttttacaccaacgtgctgggcatgaaactgctgcgtaccagcgaaaacccggaatacaaatactcactggcgtttgttggttacggcccggaaaccgaagaagcagtgattgaactgacctacaactggggcgtggataaatacgaactcggcactgcttatggtcacatcgcgcttagcgtagataacgccgctgaagcgtgcgaaaaaatccgtcaaaacgggggtaacgtaacccgtgaagcgggtccggtaaaaggcggtactacggttatcgcatttgtggaagatccggacggttacaaaattgaattaatcgaagagaaagacgccggtcgcggtctgggcaactaatctcctgccgggcgtgaactcatcgcgcccgcatctttactgcatcgacaagcaatatttgtcataatgcgcgctgcaatttatccgtattaagagaatcagatgtccgataacgctcaacttaccggtctgtgcgaccgttttcgtggtttttatcctgttgtgatcgatgttgaaacagccggatttaacgccaaaaccgatgcgctgcttgagattgccgccatcaccctgaaaatggatgaacaaggctggctgatgccggacaccacattacatttccacgtcgaaccatttgtcggcgcaaatttgcaaccagaggcccttgccttcaacggcattgacccaaacgatcccgatcgcggcgcggtcagcgagtacgaggcgctgcacgaaatttttaaagttgtacgtaaaggtattaaagcgagcggttgtaaccgcgccattatggtggcacacaacgccaatttcgatcacagctttatgatggccgccgcagaacgcgcctcactgaaacgtaacccgttccaccctttcgccacttttgacactgctgcactggccgggctggcactcggacaaaccgtattgtcaaaggcttgccagacagctggcatggacttcgacagcacccaggcgcactccgcgctgtacgacaccgaacgcactgctgtgctgttttgtgaaatcgtcaaccgctggaaacgtctgggaggctggccgctgcctgccgccgaagaggtgtaatcgagtcgatgcctgatgacatgcaatgaatcaggcatctatagtgaggctattccacgcatcatgcatgatattcacggggaatagcgttaatggcaaataatccaaacccttcatcgcccctgccggacgtgttttcaccggcgacccgcgactggtttcttcgcgcctttaaacagccgacagctgtccagtcgcgaaccacggctgggctttacgctaacagaagtgaatgacctaccggtccggcaaacgccgatgtttacgcggttacgtgaggcgggattttcaagttcgccacaagggctggattggggatagagaaaggactgacggatgcccgttcgcatccgtcagtattgcaggacggattattccgcgtccggctcttcagacttgtatttagcggcagtttctttgatcagctgctgcagttcaccacgctgatacatttcgatcacgatatcacaaccgcccaccagctcgccgtcaacccacagttgcgggaaggtcggccagttagcatatttcggcagttccgcacgaatgtccggattctgcaggatatcaacataggcaaaacgttcgccacatgcggcaagcgcctggactgcctgggcagagaaaccgcagctcggcagtttcggtgaacctttcatgtacagcaggatcgggttttcagcaatctggcgttggattttttcgatagtggtgctcattgtcttgcttcctcaaacttctttacggcagtaatctgacattgtagcgggtcagtgcgacatcggaaaataacattttcatcacgctttagctattttatccctttactctatttgttgcatttcaaatattcgtttcttccctgatgcacggcaaactggcgtatttataaccatttttagctttcactgctgcatttttttgcgctcgccaacgaaacgtattttttaacaataaaagctattaactttctcttcttctatgcattagaatcatcaagttttgtaaatcagacgcaggcatgatagacctgccttaacagagggacgctcagtggcgcggataaaccgtatttcgatcacgctctgtgctttactttttaccaccctgcctttaacgcctatggcccatgcttcaaagcaagccagggagagttctgctaccactcatatcaccaaaaaagcagataaaaagaaaagcacggcaaccacccaaaagacccagaaagccagccagaaaacagcgaaaaaagccgccagtaaaagtacgaccaaaagcaaaaccgcttcttccgttaaaaaatcttccattaccgcttctaaaaacgccaaaactcgcagcaaacacgccgtcaataaaacggcctcagccagctttaccgaaaagtgtaccaaacgtaagggctataaatcgcattgtgtgaaagtcaaaaatgccgcgtcaggaacccttgccgacgcgcacaaagcgaaggtgcaaaaagccacaaaagtggcaatgaataaactgatgcagcaaattggtaagccatatcgttggggtggcagttcaccgcgtaccggttttgattgcagcggtctggtttattacgcttataaagatttggtgaaaattcgtattccgcgtacggcgaatgaaatgtatcacctgcgcgatgcagcgccaatcgaacgtagtgaactgaaaaacggcgacctggtcttcttccgtactcagggacgcggtacagccgatcatgtcggcgtgtatgtcggcaacggcaaatttattcagtcaccgcgcacgggccaagaaattcaaatcacttctctcagtgaagactactggcagcgccactatgttggcgctcgccgggtaatgaccccaaaaacacttcgctaaaactttaccctgttgttacggcaacagggtaagttcatcttttgtctcaccttttaatttgctaccctatccatacgcacaataaggctattgtacgtatgcaaattaataataaaggagagtagcaatgtcattcgaattacctgcactaccatatgctaaagatgctctggcaccgcacatttctgcggaaaccatcgagtatcactacggcaagcatcatcagacttatgtcactaacctgaacaacctgatcaaaggtaccgcgtttgaaggtaaatcactggaagagattattcgcagctctgaaggtggcgtattcaacaacgcagctcaggtctggaaccatactttctactggaactgcctggcaccgaacgcgggtggcgaaccgactggaaaagtcgctgaagctatcgccgcatcttttggcagctttgccgatttcaaagctcagtttactgatgcagcgatcaaaaactttggttctggctggacctggctggtgaaaaacagcgatggcaaactggctatcgtttcaacctctaacgcgggtactccactgaccaccgatgcgactccgctgctgaccgttgatgtctgggaacacgcttattacatcgactatcgcaatgcacgtcctggctatctggagcacttctgggcgctggtgaactgggaattcgtagcgaaaaatctcgctgcataataactgatggcaaatgcaacattacctgatgcgcttcgcgcgccatgccaacacggatgaggcgttaacagcgcattcggcaagataaatcgcacgttgccagcaactgtaacgcagaaggttatccttctgcgtttttgtttaattagctgttggcaacgcaaactgtttcaggttgttttctgactgacataaacaccagcaataatgccagtcccgcgacaatcgcccccatcaccggcacaaaactgtatcccagcccagcggaaattaccgcaccaccagcagctgctcccagcgcatttccaagattaaaggcaccaatattgactgatgaagacagacctggcgcttcactggcgacacgcatcacgcgcatctgtaacggcggtacgaccgcaaaggttgcagctccccacactaccatgctcatagctgcgccgaactcattgcgggccaggaacgggattaccagcataatcaccatcagcaacaacaaaaagcctttcaacgtgccgttaactgaacgatctgccagtttgccgccgagatagttaccgatagaaaatccgacaccaatcagcaccagcattgccgtgacgaacaccggcgttacgtgggtaatactttgcagtaccggagagatataggtgtagagggtaaacattgcaccagcgcccagtaccgtcgtcagcaatgcagacagtacctgcggacgcattaataccgccagctcttttttcacttcaggtcgcgcccctgcgccacctttaggtaatgagaagaacagacttaccattgaaatcacgcccagccccgctgttgccagaaatgacatccgccagccgatggtttcgcccaaccaggtcgccgccggcacgccaccgatatttgccagggttaaccccataaacatagtggcaactgcgctagcctgtttatgttttggcactacgcttgcggccacgactgaacccaaaccaaaaaatgccccgtgattcaggctggtcaaaatgcgtgaaagcatcagggtcatataatccggcgcgatggcggaaagtacgttgccaagcgtgaaaatcgccatcaggaaaatcaacgcactgcggcgggcacgatgagaaagtagaagcgtcatcagcggcgcgccaaccattacgccaactgcataagcactgattaacattccggcagcgggaatcgagacatccacaccgcgcgcaatgacgggcaacaagcccattggcgagaactccgttgtcccgataccaaacgcgccaatcgccagcgccagcaacggatagttaattttcatgccttatctccacctcttcgcgtcattacgcgatattcattaaagtggcgaaagcatgacagtaatcacaaaaaaatgaaaataacaaaaagagaaaacacttttgccattttgctaacaaacaggaaggagatgcgagggagaacgcgctccctcgagaggaaatcagtgcagcgcggcagtcaaacccacggccacgatcaaaccgaggacgataatcgttgttaccagtgaaaatttaaggtcggtgctcatcaagttttctccttttttattaccacacaaaaagtgatattacgcatttttacacactgtgatgaaaaaatctcccgtcatttataatgataagtgtttttactacttccccttttcgtcaagatcggccaaaattccacgcttacattatttgcgtactggccattgaccccttcctgacgctccgtgtcgtttttccggcgtaccgcaacatttttgttgtgcgtaaggtgtgtaaaggcaaacgtttaccttgcgaatttgcaggagctgaagttagggtctggagtgaaatggaatggcaacaataaaagatgtagcgaaacgagcaaacgtttccactacaactgtgtcacacgtgatcaacaaaacacgtttcgtcgctgaagaaacgcgcaatgccgtgtgggcagcaatcaaagaattacactactcccctagcgcggtggcgcgtagcctgaaggttaaccacaccaagtctatcggtttgctggcgaccagcagcgaagcggcctattttgccgagatcattgaagcggtcgaaaaaaattgcttccagaaaggttacaccctgattctgggcaatgcgtggaacaatcttgagaaacagcgggcttatctgtcgatgatggcgcaaaaacgcgtcgatggtctgctggtgatgtgttctgagtacccagagccgttgctggcgatgctggaagagtatcgccatatcccaatggtggtgatggactggggtgaagcaaaagctgacttcaccgatgcggtcattgataacgcattcgaaggcggctacatggccgggcgttatctgattgaacgcggtcatcgcgaaatcggcgttatccctggcccgctggaacgtaacaccggcgcaggccgccttgccggttttatgaaggcgatggaagaagcgatgatcaaagtgccggaaagctggattgtgcagggtgactttgaacctgaatccggttatcgcgccatgcagcaaatcctgtcgcagtcgcatcgccctactgccgtcttctgtggtggcgatatcatggcaatgggcgcactttgtgctgctgatgaaatgggtctgcgcgtcccgcaggatgtttcgctgatcgggtatgataacgtgcgcaacgcccgctattttacgccggcgctgaccacgatccatcagccaaaagattcgctgggcgaaacggcgttcaacatgctgttggatcgtatcgtcaataaacgcgaagaaccgcaatccattgaagtgcatccgcggttgattgaacgccgctccgtggctgacggcccgttccgcgactatcgtcgttaatcacccgttgcgggagtctcttccggctcccgcagccactccttattcagcgtctcactatcgccgagatactcaagcaaccaggttaacgcaggcgacatatcattttgctgccatgtcagacaacatgccgaatccgggaaggggttttccagttctagtgctacccacttcccctcattaagccacggtttggcgaaatgtgttggcaccatccctatgcataatcctgccgagatacaggttgccgatgattcccagtcaggcacgacaagtcttttttggttatccagcaaccaggtaatacgtttaggtagcgttcgcgaggtgtcttcgcgcaccaatgacggccagttgcgcaacgtatcatcgctgaacgggccatccatcaacgccagcgggtggtggctggcaacaacgcaactccagcttaacatccccatatcccggaaggcataacgaccgcctaccggaatcgcgcgtgttgcgccaatcgccagttccacgcgcccgtcggaaagtgcatcccagacaccgttgaacacttcctgaaagacaagaagttcgacatcatcaaaatggcgataaaaatcaacgatcatctgccgtgttcgctctggcctgacaatattatccactgcgatagctaactgaccgcgccagccgttcgctatctgctgacattgctggcgggtgatctgcatttttttgacaacagagcgtccttctttgagaaaccacgccccggcagcggtcagttccacatcacggtgacgtcgttcaaaaagcggcaccgccagccactcttccagctgacgcacggtgtagctgaccgcagaaggaacgcgatgcaactcctgggctgcggcgctaaaactaccattacgcgctaccgcatcaacaacttccagagaatattctgaccacatagtctgcctgcaaaatttttgaaaccaatcatcaaatattaccgtttcacaacactaatttcactccctacactttgcggcggtgtttaattgagagatttagagaatatacatgcaacctgggaaaagatttttagtctggctggcaggtttgagcgtactcggttttctggcaaccgatatgtatctgcctgctttcgccgccatacaggccgacctgcaaacgcctgcgtctgctgtcagtgccagccttagtctgttccttgccggttttgccgcagcccagcttctgtgggggccactctccgaccgttatggtcgtaaaccggtgttattcatcggcctgacaatttttgcgttaggtagtctggggatgctgtgggtagaaaacgccgccacgctgctgatattgcgttttgtacaggctgtgggtgtctgcgccgcggcggttatctggcaagcattagtgacagattattatccttcacagaaagttaaccgtatttttgcgaccatcatgccgctggtgggtctgtctccggcactggctcctctgttaggaagctggctgctggtccatttttcctggcaggcgattttcgccaccctgtttgccattaccgtggtgctgattctgcctattttctggctcaaacctacgacgaaggcccgtaacaatagtcaggatggtctgacctttaccgacctgctacattctaaaacctatcgcggcaacgtgctgatatacgcggcctgttcagccagtttttttgcatggctgaccggttcaccgttcatccttagtgaaatgggttacagcccggcagttattggtttaagttatgtcccgcaaactatcgcgtttctgattggtggttatggctgtcgcgccgcgctgcagaaatggcaaggcaagcagttattaccgtggttgctggtactgtttgctgtcagcgtcattgcgacctgggctgcgggcttcattagccatgtatcgttggtcgaaatcctgatcccattctgtgtgatggcgattgccaacggcgcgatctacccgattgttgttgcccaggcgctgcgtcccttcccacatgcaaccggtcgcgccgcagcgttgcagaacactctgcaactgggtctgtgcttcctcgcaagtctggtagtttcctggcttatcagtatcagtacgccattgctcaccaccaccagcgtgatgttatcaacagtagtgctggtcgctctgggttacatgatgcaacgttgtgaagaagttggctgccagaatcatggcaatgccgaagtcgctcatagcgaatcacactgatctatatctatatacttatacttaggctgctaacaaaattttgttgtatgattgaaattagcggcctatactaatttcgagttgttaaaactacgataaatattatgttattacggggacaggatcgttcccgactcactatggatggtcatttcggcaagggttcctcctttccctctgttctacgtcggattatagactcgcggttttttctgcgagatttctcacaaagcccaaaaagcgtctacgctgttttaaggttctgatcaccgaccagtgatggagaaactatgagttcatcgtgtatagaagaagtcagtgtaccggatgataactggtaccgtatcgccaacgaattacttagccgtgccggtatagccattaacggttctgccccggcggatattcgtgtcaaaaaccccgatttttttaaacgcgttctgcaggaaggttctttggggttaggcgaaagttatatggatggctggtgggaatgtgaccgactggatatgttttttagcaaagtcttacgcgcaggtctcgagaaccaacttccccatcatttcaaagacacgctgcgtattgccggcgctcgtctcttcaatctgcagagtaaaaaacgtgcctggatagtcggcaaagagcattacgatttgggtaatgacttgttcagccgcatgcttgatcccttcatgcaatattcctgtgcttactggaaagatgccgataatctggaatctgcccagcaggcgaagctcaaaatgatttgtgaaaaattgcagttaaaaccagggatgcgcgtactggatattggctgtggctggggcggactggcgcactacatggcgtctaattatgacgtaagcgtggtcggcgtaaccatttctgccgaacagcaaaaaatggctcaggaacgctgtgaaggcctggatgtcaccattttgctgcaagattatcgtgacctgaacgaccagtttgatcgtattgtttctgtggggatgttcgagcacgtcggaccgaaaaattacgatacctattttgcggtggtggatcgtaatttgaaaccggaaggtatattcctgctccatactatcggttcgaaaaaaaccgatctgaatgttgatccctggattaataaatatatttttccgaacggttgcctgccctctgtacgccagattgctcagtccagcgaaccccactttgtgatggaagactggcataacttcggtgctgattacgatactacgttgatggcgtggtatgaacgattcctcgccgcatggccagaaattgcggataactacagtgaacgctttaaacggatgtttacctattatctgaatgcctgtgcaggtgctttccgcgcccgtgatattcagctctggcaggtcgtgttctcacgcggtgttgaaaacggccttcgagtcgctcgctaaaggctattctatcgccccctgtccgggggcgatttcagatcaggcttctgtacctggttgattcatggcattttctcgtgccgccagcacacgttctaccgtatctaccactgcctgagtttgtggatcgatttcaatgttgacgcgtgcgccgagttttttcttcccaagagtcgtgcgttcgagtgtttccggaattaaatggacgcaaaaacgcgttggcgtgacttcgccgacggtcaggctaataccgtcgatgccaataaatcctttgtacaggatatatttcatcaactgactatcctggactttaaaccagatctgacgattattttccgaggttaatattttcgctacttcagcggtggtcataatatgacctgacattaagtgtccgccaatttcatcgctgaatttcgccgcacgctcaacgtttacccaatcccccacttttaaatcgccaagattagtaatgcgtaacgtttctttcatcaggtcaaaactgacatggttgccgttaatttccgtcacggtcaggcagcaaccgttatgcgccacggaagcaccggtttccagaccgtccagcatgtggtcgggtaactccaccacatgcgtgcgaaaatttggtttctcgtcaatcgacaccagttttgcggtgccctgtacaatccccgtaaacatacttacaactcctgaaatcagttaagacattctgttcagcacaatagcaggtggaaaacgcccttaccagtgaaggggtaagaatggctattttttcactggagaattaataaatcctcgctacaatagactgaatttcccctgcttcttctttttgctgcccattcaggcggctttttagtctctcatataactacaaataaaaggtgttcacgtgcagaagtatatcagtgaagcgcgtctgttattagcattagcaatcccggtgattctcgcgcaaatcgcccaaactgcgatgggttttgtcgataccgtgatggcgggcggctatagtgccaccgacatggcggcggtcgctatcggtacttctatctggcttccggcgatcctctttggtcacggactgctgctggcattaacgccggttatcgcgcaattaaatggttccggtcgacgtgagcgcattgcgcatcaggtgcgacaaggtttctggctggcgggttttgtttccgttctcattatgctggtgctgtggaatgcaggctacattatccgctccatggaaaacatcgatccggctctggcggacaaagccgtgggttatctgcgtgcgttgctatggggcgcgccgggctatcttttcttccaggttgcccgtaaccagtgtgaaggtctggcaaaaaccaagccgggtatggtgatgggctttatcggcctgctggtgaacattccggttaactatatctttatttatggtcatttcggtatgcctgagctcggtggagttggttgtggcgtggctactgcggcggtgtattgggtcatgttccttgccatggtttcttacattaaacgcgcccgctcgatgcgcgatattcgtaacgaaaaaggcaccgcgaagcccgatcctgcggttatgaaacgactgattcaactcggtttaccaattgcgctggcactgttctttgaagtaacgctgtttgccgtcgtggctctgttagtgtctccgctcggtattgttgatgtcgcaggacatcagattgccctgaactttagttcactgatgttcgtgcttcccatgtcgctggcggcagcggtaaccatccgcgtaggttaccgtctgggtcaaggctcaacgctggatgcgcaaaccgctgcgcggaccgggcttatggtgggtgtctgtatggcaaccctgacggccatattcacggtttcactgcgggagcaaatcgccctgttgtacaacgacaatcccgaggttgtaacgctggctgcacatttgatgttgctggcggcggtatatcagatttctgactctatccaggtgattggcagtggaattttgcgtggttataaagatacgcgttccattttctatatcacctttacggcttactgggtgctgggcttgccaagcggctatattctggcactgaccgatctggtcgttgaacctatggggccagcaggcttctggataggctttattattggcctgacgtcggcagccattatgatgatgctgcgtatgcggttcctgcaacgtctgccgtcagccatcattctgcaacgagcatcccgctaataaagacaaggcgcaaccttcacgggttgcgcctgtgtttttacgcaggctggagcgttgcgccgatgccatcttggtctggctgtaatttcagagagttacacagagtttgccgactggcatctgttatctcaacgtgtatatcaccggtaacttcccctttcacattgatgaagtcaggtgaaatttctttcgcactggtttgcaggcaaatggctccctctccacgcaggcgtttcactttcaattgcacctgcgttgccgcatcagtgatcagccacagttttccgccattcagattgatgttaccaataccgaaagtgacgctgtcaccttttaccgtactgccgtcgagaatcaacacaccgccctgctgtacagtaatcgttgattgttgcagatctgcgccatagccaataatcattgaagcgccgtccagtaatgcaacactcccggtcagttcaaccggtgcacgatcttcctctacgacaaaattttcgtccgcgctggtgggtgacaacaaaatcactgtcccaccttgtattaccgcgttttccagcgtaccagcatgcacttcagcccgaccacccacattaacggacaggttttgcgtcttaccggaactgtagagctgaataccatccgtccccagacgataaatggatccattctcaacaatagtgtcagagtcttcaccaccgagattattcatggtgccaccagcaagcaacgtatcactggctttccccgccagcataaaaacgccgccctgattaatctcacaattgtaggcttccccacctggatacaccaacaattcaccaccttcatctaccacgacagctgaggttgtcccattgaccaacaggccgccctcttgatcgagaatgattttttccgcgcgatggccttccagtacacgcaggttaccgccattttccagcaacaaaccgcaggcataacctttatcaacgctgaattcaccttcgggatggcggccattaaccgtagcgagcgtagagagactaattgcgcctccctcggactgaacaatatctgtggcaatggcaccgtcgctgaccgatagtgtgccattgttaccgtactgtgtgcatttggctatccctccggttgccactttcaaccagccagcccccgtgaccacggtattttcggctcttccgccagcttctacaatcaactcgccttcagtaagttgcgtcgcgccaataacctcgccggtcttaacaatttgcacgttcccgtcgctcatcaagtttttcgcatcagatcccatgatttattcctttgctgcatctgtgtgcctttattgctacctaagtgtaaaggctacgaaggatttatccacgacagatttgagatggtggcaaacaactctgtttaaactctgatgcacggattattgggttgtatcagatgtaaatgcgatcctgaataaaaatcgcccttgcaaatcaacaaaatatagccaatttgcttaaaagctctgcaaacggtcgaaatagcgcagaaaattacgttttgcctcttgccaccttcccactctgccgctaatattcgtccccgttgtcacctacaacgttgcgttcatagctcagttggttagagcaccaccttgacatggtgggggtcgttggttcgagtccaattgaacgcaccatcctgcgtccgtagctcagttggttagagcaccaccttgacatggtgggggtcggtggttcgagtccactcggacgcaccagattttcttaatctggtcttcttctttgtccctctgtttcttctctgtatccaatacgttaaaagatctacactgtcttcgtgtgcgttatcagaaggagaatcgctgtggcaactttgttacaacttcattttgcttttaatggcccatttggcgacgcaatggctgagcagcttaaaccgcttgctgagtcgattaatcaggaacctggttttctgtggaaggtttggacagaaagtgaaaagaaccacgaagccggtgggatctaccttttctctgatgaaaaaagcgcccttacctatctggaaaaacatactgcccgactgaaaaatcttggcgttgaggaagttgtcgccaaagttttcgatgtcaatgtgtcactgagtcaattcaatcaggcaaaacttgcctgacagattttaatcaagggcggttagtgcccttttcatccctgtctgaaatttctcaaattctaaaaatctcaaccaaacttacctgataacactaaattcgaaagaatgcgtacaggtaagtaacaatgaaaacaattgctattgtgggtgccgggcctacggggatctacaccttattctcgcttctacagcaacaaacgccactttctatttctatcttcgagcaggctgacgaagccggtgtcgggatgccatacagtgatgatgaaaactcaaaactgatgctggcaaacattgccagtattgaaataccgccgatttattgcacgtatctcgaatggctacaaaagcaagaagccagccatctccagcgttatggcgttaaaaaagaaaccttgcacgatcgtcagtttttaccgcgaattctgctgggcgaatatttccgcgatcaatttttacgattagtagaccaggcacgacagcaaaaatttgcagtggctgtttatgaatcatgccaggttaccgatctgcaaattacaaatgctggcgtcatgatcgctacaaatcaggatttacccagcgagacgtttgatttagcggtgattgccacgggtcacgtctggcctgatgaagaagaagcaaccagaacgtattttcccagcccgtggtcaggcctgatggaagcaaaggtcgatgcgtgtaacgtgggtattatgggaacatccttgagcggactggatgcggcaatggcagtggctattcagcatggttcgttcattgaagatgataaacaacacgtcatttttcaccgcgataacgcaagtgaaaagctaaatattacgttaatgtcgcgcacaggtattttacccgaagccgatttctattgccctattccctacgagcccttacacatcgtcactgatcaagcattaaatgctgagattcaaaaaggcgaagagggccttttggatcgggtatttagattgatagtagaggaaatcaaatttgctgatccagactggagccaacgcatagccttagaaagcctgaatgtcgattcctttgctcaagcctggtttgccgagcgcaaacaacgcgacccattcgactgggcagaaaaaaatctccaggaggtcgaacgcaataaacgagaaaatcatactgttccctggcgttatgtcattctgcgcctgcatgaagccgtacaggaaattgttccacatctgaatgaacacgaccataaacggttcagtaaaggccttgcccgggttttcatcgataattatgcggcaatcccttcagagtctattcgtcgactattggccttacgtgaagcgggaatcattcatattctcgctctcggtgaagactacgaaatggaaattaacgagtcgcgcaccgtcctgaaaacggaagacaacagttactcgtttgacgtttttattgatgcccgcgggcagcgtccgcttaaagtgaaagatattcctttccctggactacgcgaacaattacagaaaacaggggatgaaatccctgatgttggcgaagattatacgttacagcaacccgaagatattcgtgggcgcgtagcgttcggcgcgttgccctggttgatgcacgaccagcctttcgttcagggacttacggcatgtgcagaaattggagaggcgatggctcgggcggtcgtaaaacctgcatcccgtgcgcgtcggcgtctttcgtttgattaaaggtaaagctatcagcactcaacaaactgatgttgttcattaagacgatagcggactccggctcgaatattgttttcaccttcaatggcgacggcgaagcgaactctttcgccgtcatgatatgcgagtgcggcgcatccccctggcccgagaataattgagtcgaccacgcccgtgctcactactgttgaattttcaccgctggcaatgatgtgtacattgtcgccgcagttggcaattctggcgtttgcgccaaagctggcgatttgcactaggtcaccattactggcgacatgacaccgttcacccaatgtacaaacgcgtactcgcattccggtattcgcaatccgactgctatctccagcgctgcttatccgcgaagaattaccggttacagcaacccgtgcgcgtgcaccggagctgccaatgtgactgttaaagccgacacttccaatccgcacgctataacccatactggcaatttgcgcggcatacccagcggttgcgattctggcgttatcctcacaacagccgatgcgagcatgatcgtcgctgcgggcaaactgactgcaaaatagtcgttctccgggatctgtggccagtttttgcatagaagaaacttcctgatgcgcgaagttttcatccgccagccattttttccacgcatactcaaccagactctccgcccagtccgtatatccttcctcaatcagtgcatgatgaatatcggcataactaccgccacgtgggaaatggcgcagaaaccagcgatacatcaccgctccgatacgccattctcgcaggtctgctcgtgtaatgatcattcgttagtgccggtgatagccatcgaccatgcttttaaaggtttcgtgtggcgtacgccccgtggtgcaaagataaagatgaccgaagataaaaaagaggcttataaatgccagagcaaaatgcgcctgcaataaccagtatcttacgccaggaaacatatctcccacggcttgcggatagagacacagcagccccgtcaatagtaacaatggcagcaatccatacatgacaccaacataggcgacctgctgtaagggattaaatttagactgggttgttgccgggaaaggatgttcttccccctgcataatgccaaacaaataaaatcgcgtttgttttgccgctcgatccagccaaccctgacgacgaatgcgatagtggtgaccattacccccaacggcattgatcagaacaaagccgagccagcatgccagtaacaaaaatccgcaaacttcatgcaccgcaaccagacttttaaccgcagttgcgcccaccagcgcaaagtgatttatcagcccacttgccagcaacaatacaaagagtaacgcattcgaccagtgccataatctgaccgctttgctgtaaagataaaccttctcaccatggtcggtggctgatttcttcacgccacgagcacgaagcaaggcatgcagccccagcaccaaccacatccctaccagcaatagtccggcaatgatcaaccacaccggccaaaattggggagtgaacagtggcacatagttcgccaactggctctgaaactgttcagcatgttgcgacgggttcatacattttcctttttaatcaaatgttgaccgaaccggcgatacaggtgcggtttcccggcaccaggtagctgatattgatagtatttattttcctgcaaccacgcctgaatttctgggctatcttcgcgaccaaagatcaatgcgtgttccggacaggcgctgacgcaaatgggcggaaagccttttgccagtcgggactcagcgcagaaatcacatttatctgccactttagtgacagggttaaggtagcgaacctggtaaggacaagcgccaatgcaataactgcagccgatgcactgcgatttttctacccgtacgatcccctgctcatcacgccacgatgccgctgtcggacaaacgtcgatgcacggagcatcttcgcagtgctgacatgactggcgaaaaaagtgatactgcgtttcgttgtcgttatcggtgactggaatgtgtgctatcgataaacggcttccctgagcggggacgtggttagttttacggcatgcgcgggcgcaaatattacagccattgcaccgtgactcgtcatgaatcatggcataccgaacttccttttcttgcctcgtgttcgctaacagagaagacgcagaaccagtaaaaaagattactgttcccatccccagaacaaatttgcgtcgagtgaaggacatctgattatcccctaatgcagtggctgctactgtccaccctatccatgacatctccctgaaatttcaggggttctgaaactgctctacctcgaaccattcgcataagccatacgccttgccataggtcataaatcgctcgctaaacaagtacaacactgccgtcgatgactccacctgccgtatatcggcatattcaggtgcaacatccatcgtggcgatcgcggcttcaatctgcgcttcctggaagtaatatggcgcttgcatcagcatggcgactttgtaaggacgaggatacgtctggcactcaaaacgaacggcgtgtgcaatggcgcgacaaatgtcctgctccacaacttgcaaagacatcgctgcgtagttttcactcatggcctgcgttgagtaatagtaatcatcctggcttcccgtcatacaagcgatatccgcgtagtctccgttctgcttaatgttttccagcaaaactgacagttcctcttctgcaaccgaatagggtggcgagagaaacacggcgcgcgccaccagctgcccagccgcagaatgctggcgaatgaactctgccaggatttcagccggttctggttcggttaccgtatcaacggggtgacgcatcccctgcaaccattgccgcttcgcctcatcaatttcgctgacttccgctaacggcaattcatcctgatggttcatctctcccattccttacgcaggcagtagattgtgtgctgccagatcggcggcaatatcttccagccccagacgctgcaatgtttcgcgggtcggacaaccaagctgtgggtcccagcccatttctttgtagaacatcgtgagcgaagcatgcatatcgtcacgatccattttgtctgtaccttcagtaaagaccggaatctgcggatccttgtcgaatacccaggaacagataagatcgtgttcattacgcatatctttggtttgcatcagttttaccgtgtaggcgcgatgcaacgtaaagatacgctctgcagctaaatctaatttttcctgagtcatatcttcgccagtgatcgctttgaagaatttggcttcaagcgccagatcgccccgataattacggcttttcagcggcgaaacggtcattggccagacccagttgcacagggtgacggcgttatgcaaacagacccgcaacagcgaccacttagcatatttaatttttgcgtcattgattggcgtgtagtttttggtttcatcgtaagcatcttcagaaccaaaaagctctttcgccacttcacgctgcaatttcaatggcaagccggaaccaataaaattgatatgggtatgcgtcatgcagtcacggttgaacatacagttaacaatggagccgacctgcgctgacgcttcattggcgtggtgaactggatagccaaacggcgaccagagtttatttttcgcgtagccccagtactcttcacccaaattccagcgttctgcgatggcatatgaaccatcagccaggtgactcagctcacccacgcgatgcgccagacggtagtaaaaatctttaatgaagttaacgtcacccgcttccagttgatcccagcgaatttccgcatactcttcagcaggcagaaacacgcttgaacacccctttgctgtaacaataggtaaagtcgcgatgaagctgaccatagttacaccataggccgtagtcatcgaacagattcagaccaaccaggttaccaatcacacgaccatcatctttatcttcaaaatctttcggcccgttcgggaagatggtggtatggacaaagtttgctacacaagtgttaccacctgtgctgggcacgccaaactctttcacccgaggaatattcatttgggtcatacaacggatcgggcaagagtggcagccactcatttttactgtgtatttctctgccgccggacctaagtcaaaaacggatttataggtacgaaagccgaccgtgttctgattgcctggaggaatttcccccgtttcaatcggaccaccttcagccgcgccccaaaacagccctttacgtgctgtccaacgtgacttgggatctgaatactctgcccacgattgcggcgtacttggcacgacatggttgttattcgcaccgataagttcagtcatcatgtaatcgttgagacgcttcatctcctgacgatcggcaatgttgacccctttcgtcccttcaaccgcaatcgctttcaggtttttcgaacccattattgcgccagttcccgcaccgccgctgtggttacggctattcaacatgccagagagaggaacaaggttttccccagcctgaccaatagccgccacacaggtttccggactggtcaagcgacaaatttcttccgtcgttgcgcgcgtcccttttccccataagaaatcggctttttcaaggctaactttgtcatctttaatcttcagccataccggtgatttcgctttcccttcgataataatgacgtcgtatccagcgaatttcatttgcgctgcaaaaaagccccccatatgggcatcgacgactaaatttcctttggtaaaagtagaaagtgaagtgatatttacgcgagaactacagggggcaccagatccagttaatgggccggtagcaaaaactaatttattcacttcatcgaaaggtttcgtgcctggcggtacttcgtcatacataattttgtagccgaagcccatgccaccgacaaaacttttaaacttactggaatcttcgagggtaatatttcctgtcgtgagattgactcttaatatattacctgtccaaccgttagccatgattttttcctttgcaagattcacacagtaatatctttccactcgataatttttaacgcccctgttgggcaggcgtttgcgcattcaccgcataacacacatttcgaggattttttactttcggtatttacggtggccatcatccacgggcatgccgtcgtacaggcgctacagccaatacaacgtttatgatcgacggtaatacagccttctttctgctgccaggtaatcgcaccaatcgggcagacgttcatgcattgcggctctttgcattgacggcaggtatccgcggtatagttgagatcgccatacaggccaccgccagagccaaccccgttgtcgccaaagaaataattgcgatggattttgatacgggagaagaatgtccctactgagccatcgttgaagttggtacaagagatttcacagcggtggcaacccgtgcatcgcgcacgttgggtcaccagcacccctttgggtgtatttatcaaccctactgtgccgctatcaatatcttcctgtttgcaacccaaaagtgacagtaaagcaggggcaattgttaaaccagcaaggccttttcctgatatacgcaagaattctaatcgcgttaagccaatatttaatagtggacgatcaaccgggttcatttatttcgcatcctcttcgcaaacacagtgctgacaattcagcagcctgatattaggcactcaactaatacgctgctgactctgtcctcaacaccagatattttcccaaacccgatagtgtatgagaaaagatttaacgctgacaaaccaatcctttatggttaggagaaaaaataatgtgattattctgggctcttaacattgatcgttatcaattaaaatcacaaagcaaggaattataagcgaactgatatttattatcatttgaaataaatttaacttaaccgacaattatttgtgaagttcatcgcagaaaataaaaataactttatcgctataaattaaaatacacaccgaaattcatataatttcagcagttgttatttagaatgattaactggaccgcaactgaactaacaatatcaggatgaagcttaccgcctcatcctgaatggtcattttaccagtgcgttaatgactgtttccatcgcctgcttttccagctcactgcgctgaatgcgtttattggctaatgctgtacgtaatacgcctgcgataacaatatgctttggttcctgccccagatcgcgcatttccagcacaactttaccgacaactctgcacatttctcggtacagttcatcctcttttgtccggtttcccattctttatacctatttatcatgccaactatcagcatatatcaatctaaccaattaaacaaaaatcaaacaaaatcagacaaataacgtgataaattattttaactgtagcaattgagcgatgatgtatttatacaccggatgaacttttcacttatcctcacactgacaaccccggcaccagacgttgcgcaaacaacgaagtttttgcgtaaccttttccctggaacgctgaatctttgataacaatttattgtcttacaagttgtatattttttgaaacgctgtttttgttttccttttggattaatttcagcgtataatgcgcgccaattgactcttgaatggtttcagcactttggactgtagaactcaacgactcaaaaacaggcactcacgttgggctgagacacaagcacacattcctctgcacgctttttcgatgtcacctatccttagagcgaggcacaaccactttcgtaataccggattcgctttccggcagtgcgcccagaaagcaagtttctcccatccttctcaacttaaagactaagactgtcatgaaaaagaccaaaattgtttgcaccatcggaccgaaaaccgaatctgaagagatgttagctaaaatgctggacgctggcatgaacgttatgcgtctgaacttctctcatggtgactatgcagaacacggtcagcgcattcagaatctgcgcaacgtgatgagcaaaactggtaaaaccgccgctatcctgcttgataccaaaggtccagaaatccgcaccatgaaactggaaggcggtaacgacgtttctctgaaagcgggtcagtcctttactttcactactgataaatctgttatcggcaacagcgaaatggttgcggtaacgtatgaaggtttcactactgacctgtctgttggcaacaccgtactggttgacgacggtctgatcggtatggaagttaccgccattgaaggtaacaaagttatctgtaaagtgctgaacaacggcgacctaggcgaaaacaaaggtgtgaacctgcctggcgtttccattgccctgccagcactggctgaaaaagacaaacaggacctgatctttggttgcgaacaaggcgtagactttgttgctgcttcctttattcgtaagcgttctgacgttatcgaaatccgtgagcacctgaaagcgcacggcggcgaaaacatccacatcatctccaaaatcgaaaaccaggaaggcctcaacaacttcgacgaaatcctcgaagcctctgacggcatcatggttgcgcgtggcgacctgggtgtagaaatcccggtagaagaagttatcttcgcccagaagatgatgatcgaaaaatgtatccgtgcacgtaaagttgttatcactgcgacccagatgctggattccatgatcaaaaatccacgcccgactcgcgcagaagccggtgacgttgcaaacgccatcctcgacggtactgacgcagtgatgctgtctggtgaatccgcaaaaggtaaatacccgctggaagcggtttctatcatggcgaccatctgcgaacgtaccgaccgcgtgatgaacagccgtctcgagttcaacaatgacaaccgtaaactgcgtattaccgaagcggtatgccgtggtgccgttgaaactgctgaaaaactggatgctccactgatcgtggttgctactcagggcggtaaatctgctcgcgcagtacgtaaatacttcccggatgccaccatcctggcactgaccaccaacgaaaaaacagctcaccagttagtactgagcaaaggcgttgtgccgcagctggttaaagagatcacttctactgatgacttctaccgtctgggtaaagaactggctctgcagagcggtctggcacacaaaggtgatgtcgtagttatggtttctggtgcactggtaccgagcggcactactaacactgcatctgttcacgtcctgtaatattgcttttgtgaattaatttgtatatcgaagcgccctgatgggcgctttttttatttaatcgataaccagaagcaataaaaaatcaaatcggatttcactatataatctcactttatctaagatgaatccgatggaagcatcctgttttctctcaatttttttatctaaaacccagcgttcgatgcttctttgagcgaacgatcaaaaataagtgccttcccatcaaaaaaatattctcaacataaaaaactttgtgtaatacttgtaacgctacatggagattaactcaatctagagggtattaataatgaaagctactaaactggtactgggcgcggtaatcctgggttctactctgctggcaggttgctccagcaacgctaaaatcgatcagctgtcttctgacgttcagactctgaacgctaaagttgaccagctgagcaacgacgtgaacgcaatgcgttccgacgttcaggctgctaaagatgacgcagctcgtgctaaccagcgtctggacaacatggctactaaataccgcaagtaatagtacctgtgaagtgaaaaatggcgcacattgtgcgccatttttttgcctgctatttaccgctactgcgtcgcgcgtaacatattcccttgctctggttccccattctgcgctgactctactgaaggcgcattgctggctgcgggagttgctccactgctcaccgcaaccggataccctgcccgacgatacaacgctttatcgactaacttctgatctacagccttattgtctttaaattgcgtaaagcctgctggcagcgtgtacggcattgtctgaacgttctgctgttcttctgccgatagtggtcgatgtacttcaacataacgcatcccgttaggttccacggaatatttcaccggttcgttgatcactttcaccggcgttcccgtccgcacgctggagaataaagctttaatatccggtgcattcatgcgaatacagcccgaactgacgcgcaaaccgacgctgtccggcgcactggtgccatgaatgaggtattcgccattaccatgcgcgaggcgcagtgcgtaacgtcctagtgggttattgggcccggcaggaacgactggtggtaatttaatgccacgttccagcgaacgttgacgaatgcccgccgtaggcgtccaggttgggttagggattttctgccccacacgcgtttccatcaccggcgtttccagcccctgcaaaccaatacctatcggataaacctgcacgatattttctcccggcggataattataaaggcgcagctctgcaaggtttacaataatcccctgacgcggcgcatcaggtaataatagttgtgaaggaatagttatcgtcgtaccgggttttggcaccggggcgatagtgttattggcttcaaggatcaacattgccgcagtatcaaaacgtcgggcgatggcctgaaggtttttatccccttcttgcaccgtatacgtttgattttgcccaaccagtcgactgccggttggtggtagcggataatcaaccgcccaggcagcctggatggcgctaaaagcgccgataagcgtgagtgtaagcaaagacgcgcgtttcattgtaaacctcctgtatttgccggagactcacgctgaaacgtcggatggcgcttatgttcacctgaaaccaaaacactcctgtgcaggccagtgtaaacattgaccacccggcaatgtgagccaaccggatgaaagctgtccctttagtttagctaagtgcagcggctttggcgcgaattgcgcgaatcatcgcttccagaccttgtgagcgtgatggggtgagatgttgggtgagcgccattttttcaaaccacgggcgcacatcgaaattgacaatatcctgcggcgtcatttgatcgtaaagaataaagacgaccgcaataagcccttttacaatggccgcatcgctgtcgccctgtaattcaataattccctgcgcattttgacgcatcacaatccacacctgactctggcagccctggatgctattttgcgggcttttgtcttcgtcacgtaattctggcagacgctgacccaactcaataatgtagagatatttctcttcccagttggcgcagcgtaaaaaattacgcagcaatttttctttatccggcaataaagccatagtgcctccctgttatcccagcagacggtgaatacgttgcaggccggtcaccagacgatccacttcttcatgggtgttatacatggccagcgatgcccgacacatcgcagggacgttgtaataggccattaatggcattgcgcagtgatgtccggtacgcacagcaatgccgtaattatcgagaaaactgccaacatcataggcgtggtgtttaccgagattaaaagcaataacgccaagcctgttttgtgggccatagagagtgagatccggtacagattccaactgtgataacgcgtaatgcatcagattctgttcatactcggctatgttattaagccccagcgccgaaacatactccagcgccgcgccaagaccaatgatgcctccggtattgggtgtaccggcttcaaaccgccatggtgctttggtccaggtagtgccttcactcaggctgacggtggcgatcatagaaccgcccccttcccacggcggcatctcctgcaacaaggcttctttgacataaagaatgccaattccggtagggccatacagtttatgcccggagaacacgtaaaaatcgcaatccagcgcctgaacatccaccggatgatgcatcaccgcctgagcgccatccaccagcacttttgcgccatgttgatgcgcaagtgtgatcatctccgccagcggattttctgtcccaagcacgttggagacatgagtaattgccagcagacgagttttctcatcaaacagcgtaggcagcgtctccagttgcagagtaccgtcggggttgagcgggatcacacgcagctctgcgccaacgcgtgcacaaagcatctgccaggggacaatgttagcgtggtgctccatctgactgatgatgatgttatcgcccgctcgcacattgctgttgccccagctattggcgaccagattgatcccttccgtcgtgccgcggacgaacaccagctcttccgccgaacgggcattaataaacagcgatgcccgcttgcgcacgttctccattttctcggtcgcctgggcgcttaaggtatgaataccgcgatgcaccgccgcgtagccatgacgataaaactcagcctcggcatcaatcacctggctcggtttctgcgcactggcggcgctgtcgagataagccagcggcaaaccgtttacctcacgagaaagcaccggaaagtcggcccgcactttgtcgacggaaaaagtcatcttgcacctcctggcagtcgttgaccgattcgggccagcacctgctgtttaagcccctcatcacgcagtgcttccgtcagttcggcagcaaaggcgtaaatgatcatctgctgggcatcttgctgattgatcccgcgcgagcgcagataaaacatctgttcgtcatcaatacgccccaccgtcgcgccgtggctgcatttcacatcatctgcatagatttccagctgcggtttcgtatccacttccgccagtttgcccatcagcagattattgttggtcatctgaccatccgttttgatggcgtgctgcgcgacgttgatcaaaccgttaaataccgcgcggcctttgtcgctgacgatagttttgtgcaactgtcggctgttacaaaaacctttattgtgttccaaccaggtacgagtatcacacacctcgtttttcaccggcatcgccaggctattgatccgcagcgtgctgttttcgccattgagttgcgtactggtgttgtgtcgtaatactgcgccacccagcaggaaactgtggctaaatgcggtggcatcgtcagccagcaacaaatcgttatgagcaaagtggtgactgagcgggttttcaaacgccagcttgatatgctgcaaatgggcgttcgctgcgacgttgatagtgaaccgtgcgccggtgaagtgacgagcatcattaaggctgacaaaatgttcgatcaccgttgcttcggcaccttccgccagatccagatgatgccggtaatgggcagtattcacctcttcacctgccacgccctgggtgatatgcatcaacagcaatggctttgccggccgttgaccgcgcttcacggcgatatgcgtcacgctttgtgccaggctttccgtcaaatgcagaaacacttccgcctgaatagcatcgggtaacccctgacggtcgtcgttaatgctcacttcatatccgctgccttcagttgcatcgctcagtgcgggcacgtaacgtccatcgacaaacaccagccgcacggcgtctaatgttaacgctaaggcatcacgctgctgtggggatatctcccccgcaatgctgacaaactggctattggtcagcccgtccagcggcgtatatttccagttttcatgtttacgtgtcggcagtccggtacgcagcaattgttgtaaatgctgctgtgcttgcggggagcgtttcgccccttcagcttcaaacaaatgatgccactgttgcagtgcgttactgctgttcggtaagccagccataaccctgctcctccagttgtttgaccaacgtgaaatcgccggatttcacaattcgtccctgatacagcacatggacgtaatcaggcttgatgtagtcgagaatgcgttggtagtgcgtaacaatgatgaatgaacgcttgccgtcacgcagcgagttcacgccatcggcaaccacttttaatgcgtcaatatccagcccggagtctgactcatcaagaatgcataactccggttccagcaccgccatttgcaaaatatcgttgcgctttttctcgccgccggaaaaaccaacgtttaccgaacgggttaataaatcttccggcatcttcaggagagcgattttctcttccatcaaatcctgaaaatcaaagcggtcgagcgtttcctggccgcgatagctgcgcaccgcattaagtgccgtttgcaggaaaaactggttactgacgccgggaatttccaccggatactggaaggccataaagatgccttcacctgcacgatcttccggcgacagcgcaagcaaatctttgcctttaaactcaaccgtgccgctcgtcacttcataatcttctcgcccggcaagcgttgccgataaggtacttttgcccgaaccattgggccccataatggcgtgaacttcgccgggacgaacgtcgaggcttaatccacgcaggatagctttatcttccacgctgacgtgtaaatctttaatacttaacatgtttattccttatccgacgctgtgttcaagactgatggcgaggagtttttgtgcttcaacggcaaattccagcggcagttccgagaacacgtctttgcaaaaaccgttaacaatcatcgagatggcatcttcttcgctgatcccgcgttgcaggcagtaaaacagttgatcttcaccaatacgtgatgtcgttgcctcgtgctccagctgagcgctgttattgcgacattcgacatacgggaaggtatgcgccccacaattagcgccaatcaacattgagtcgcactgagtgaaattgcgcgcattggttgccgtcggcatgattttcactaagccgcgataactgttctgactatgtccggcagagatccctttcgagataatggtcgatttggtgtttttaccgatgtggatcatcttggtgccggtatccgcttgctgatgaccgctggtcagcgccactgagtaaaactcaccaatggagttatcgccgcgcaaaatgcagctgggatatttccacgtaatcgctgacccggtttctgattgcgtccatgacattttgctgttttcgccttcgcacaaagcacgcttggtgacgaagttgagaataccgccggtgttgttatcgccagggaaccagttttgtaccgtggaatatttcacctcggcgtttttatggatgatgacttccaccaccgccgcgtgtaactgatagctgtcacgcaccggagcggaacagccttcaatgtagctaacgtagctgtcttcgtcggccaccagaatggtgcgctcaaactgcccggttttttccgcgttaatgcgaaaataggtggaaagttccatcgggcaacgcacgcctttaggcacataaataaacgtaccgtcagaggctaccgccgcattaagtgcggcaaagaagttgtcattccccggcaccacggtgccgagatatttacgcaccagttccgggtgatcgtggatcgcctcgccaaaggaacaaaaaataattccctgctccgccagttttttgcgataagtagtggcaaccgaaacagagtcgaaaatggcatccactgccacctctttgccttcccgcacgggaacgcccaactgctcaaacgccgcctccacctctttacttaaaaaggcgttcgcgccagtttgctgcaccgcgccgggttcagacgcgcagttgtcgtcacaattaccgcacgatggtgccgagtagtagctgtaatcctgataattcagcttgtcgtagtgcgctttcaaccagtgcggttcttccatctccagccatgcgtgataggcgttgagacgaaactccagcatccactccggctcattacgcttcgccgaaattgcgcgcaccacctcttcgtttatcccctttgccagctcatcggtggctaactgggtgaagaatccttctttataattcagcgggccgccggtccaggttttgacatcgtcagttgcttcagtattacgagacatagtaccgcctataccccaaagctttcgccacagccacattcattctgggctttagggttgtgaaatttgaatatctgattaagtccttcgcgaacgaaatcgacttccgtgccatcaataaaaggcatcgcttgcagcgggacaaacagcttcgcgccgtcgtgttcaaacagcagatcgtctttgtccggctcgctaacactatcgagcacatagccaaagcccgcgcagcctgtttgcttcacgcctaagcgcacgccgatcatacccggctgctttgccaccagctcgcggatgtggacagcggctgcgggtgtcagcgttaagccctgccaggcgaaatcctgtggattaaaggttcctgaatgcatgtccatcgatttacctcacttcatcgctttcagcgtataacagcatgttagtgataatgattatcagttcaacccagcaaacgcaggggctttagcgtaaaacatgcttttttcctgcttttaataagcatagaccctgatgtgtgggttaacaggcacgctaagaattaggtatctcattgttagataatgattattatctaaggagcattaaggctgtgatgaaaaagaaaaagttgtattgaaaatgactatttaagagataggtaaaaaagtgcagcgttcagaaataagaaaacccttaagtctgtgcgacacaggcttaagggtttctaccccatccggcgcttatctccggcactcacagtggcttagctcttgaaggggcgataaggataatctcataaagctaacccactgttttaacacaaactgcgatttgtattatttttgaacgttatcaggcgggtagataggctgtattaaaaaggccctcgaacctggacgaagattaatccaggccgatttggcgaactcgcgacattaaatcaggatcaatgcacgcccagacgccaggcgaagtagatttcttcttttaattcagcagaagagagagtaagcaggtcagcaaattcaagttctaattgtttcagacgcttgagatattgggcaggtgaaagattgctttggtcacggcgtaaaaattcaatggccagttgggtgggatcaagttgagtagacatagcatcctcgcttttagacaagacctgcacagtataccaccgtttactgtgcagataataaccaaaagcaatatgcgtcacacttttctggtgacaacgtcacaaaatagcggtcgtcaatcgtgacgaacagcacaaacgccctttctcatcgaagatttcaatctgccagacctggtgacgcgaaccgagatgcaacggtttgcatacgccgcgcacccgcccttctcgtgccgagcggacgtggttagcattgatttccagaccaaccactttttgctcaccttcggtacataaataaccggcaacggaaccgatactttcggccagtaccacggatgcacctccatgcagcaacccgaaaggctgctttgtccgtgagtctactggcattgtcgcttcaagggtgtcatcaccaatatgttcaaagcgaatatccagcaatcccaccatgtttccttcccccatagcattcagtgcttccagggtgatttttcgtttccatatcatttaataatctccagtaaagcctgcacaggatggcgtacccctgtgccttcaacccgttttacctgactacggcaggaatatccggtcaccagacagcggttacgcggcagtcgctgcatcgcctgatgccaggataattcatagatcccgagcgaatttttatggtttttcgcttcatgtccgtaagtccctgccatgccgcagcaccccacgctgacattttccagtttcgcgccaaaacgggcaaatattgccgcccattgtgctggcgcgcccggcaaggcggtaacttcggtacagtgaccaaagaaataccatgattcaccgctgactgtagccactggctgtgactcaagtgcgcttgccagccattcatttgccagtaagacgttaaactcgccacgctcctcgcccagcgccagtttatattcatcgcgataacaaagtaccagcgccgggtcgacgcctaccattggcatacccagcttcgccatacggttgaggaaatccgccgtctttttcgccgtcttcgcaaaacgattaagaaaacctttgatatgctgggcttttccatttggcgaaaatggcagtaacacgggctggaaacctaatttttcgaccagacggacaaaatccgccaccacttgagcatcgtaatagctggtaaaggggtcctgcaccaccagcaccgtgcgcgctttctgctctgcattgagagcttcaagctgttccagcgtcatgtttgccgagcgatgccccaccatttgttgttgtagcgaggggaccgacagcagcggcaaatcaaccatgccgatatgtttttccgagagtttgcgcaccagcggctggttaatgaagaagttaaaggttttcggcgcgcgtgccatcagcggtgcgtaactctcaaccgtagcgacgaggtggtcgcgcagcgggcgtaaataacgggtgtgatagagttgcaggaaacgagagcgaaactccggcacatcaattttgatggggcactgagtcgaacaagctttacaggccagacagcccgacatcgcctctttgacttcgtgtgagaagtcatattcgcctttattcgcatgccaactattgcgcgtgcgggcaattaacgtccgcaaactgacgccggattcaggcagttcttgttccagtttgagtgggtcaacgccgcgatccgccaacaaacgcagccattcacgtaccagcgttgcgcgccctttcggtgaatgaatccggttctgggtgatcttcatcgacggacacatcggactacgagcatcaaagttgaagcataaaccgttgccgttacactccattgcaccacgccactgctggcgtaccgcaatggggatctgtcgatcgaatgtaccgcgcttcaccgcgtccactttcatcatcggcgcatcgagaccttctggcgggcaaatcttcccggggttgagtcggttatgcgggtcaaatgccgctttcactttacgcagttctgcaaaaagttcctcaccgaaaaacgccgggctgtattcggcgcgaaaacctttgccgtgttcgccccacaacaaaccaccgtatttcgcggtaagcgccactacatcatcagagatttgcttcatcaaaatctcttgttgcggatcgcacatatccagtgccggacggacgtgcaagacacctgcgtcgacgtgaccgaacataccgtagcttaagccgtggctgtcgagcagcgcgcgaaattcagcaatataatccgccaggtgttccggcggtacgcaggtatcctcagcaaacggaattggcttagcagcacctttggcattgccaagcagaccaacggcttttttgcgcatcgcatagatacgttcaacacccgccagctcgcggcacacctgccagccgatcactcctgcctgttggctggcaatcagctcatcaagccgcacacagagtgcattaactcgctcgtcaatcagtgcctcatcatcaccggcaaattccacaatgttcagcccgagcatctctttatcaggcacatcggtaatcaactcgctgacggaatgccagacaatatcttcccgcgccagattcagcacttttgagtccaccgtctctaccgaaagcgcccgcgcctcaaccataaacggcgcgttacgcagcgcggagtcaaaagagtcatatttgacgttcaccagacggcgtactttaggcaagcgcgtaatatccagtcgcgcttcggtaataaaggccagcgtcccttctgaacccgtcagaatgcgcgtcaggtcgaactcggtcatctcatcgttaaagacatgacgcagatcgtaaccggtaagaaagcggttaagcttggggaagttgtcgatgattaactgacgttgctgacggcaacattgataaaccgtgttataaattcgcccgattgtggtattggatttacccagcgtttccaccagttcgacgggtaaaggttgcgtatcgagaatatcgccccccaacaacaccgcgcgtacgccaagtacgtgatctgacgttttgccatagaccagcgatccctgaccggatgcatcggtattgatcatcccgccgagcgttgcccggttactggtcgaaagttctggcgcaaaaaagtagccaaagggtttcaggtactgattgagttggtctttaatcaccccggcctcaacgcgcacccagccctcttcagggtttatttcgatgatgcggttcatatggcgggacatatcaacaataatcccctggttgagcgcctgaccgttagtgccggtgccgccgccgcgaggggtaaagatcaacgatgaatagcgttcctgcgcggcaagacgggcgatcagcgctacatctgcggttgaacgcggaaataccaccgcatcggggagaagttggtaaatactgttgtcagtcgacattgtcagacgatcggcataacttgtcgccgtatcgccggtaaaaccctgttgctccagctcttgcaaaaaattaagcaccagttgaacgacgccgggtgcctgggaaatctgtggaatcattatattgaccctttcctgcggtctgtgatgagagattaatcgtttgcgtgttgcctgagttgttgtaccacatttttttcttacacgcccatcagaattaagggcagaatcgacctgttaaaaaccgctgaaattgctcatcattatgcaggtgagtttcgcgtgttcacgtcgcgtcgacgatttgacgcacaaaaaaggtgaaaagtagttatggtaaatgttcgtcagcccagggatgtcgcacaaattctgctttcggtgctgtttttagccatcatgattgtggcatgtctgtggattgtacaaccctttattctcggctttgcatgggccggtacagtggttatcgccacctggccggtattgttacgtttgcaaaagatcatgtttggtcgccgctctctcgccgttctggtgatgacgctgttattagtgatggtgtttatcatccctattgctttgctggttaacagtatcgtcgacggcagcggcccgctaattaaagccatttccagcggtgacatgacgttacccgatctggcgtggcttaataccattccggtgattggcgcgaagctatatgcaggctggcacaatttgctggatatgggggggacggcgatcatggcgaaagtccgtccttatattggcaccaccaccacctggttcgttgggcaggcggcgcatatcgggcgctttatggtgcattgtgcgctgatgcttctcttcagcgccctgctgtactggcgcggtgaacaggtggcacaaggcattcgccattttgcaacccgtctggcaggcgttcgcggagatgccgccgtgctgctggcggcacaggctatccgcgcggtggcgctgggtgtggtggtgacggcgttagtacaggcagtgcttggcggtatcggcctcgccgtatccggcgtaccttatgcaactttgctaacggtgttaatgatcctctcctgccttgtccagcttggaccgttgccggtactgattccggcgattatctggctctactggactggcgataccacctggggaacggtattgttagtttggagcggtgtggttggcacgctcgataacgtcatccgcccaatgttaattcgcatgggtgccgatttaccgctgatcctgatcctctctggcgttattggtggtttgattgctttcgggatgatcggtctgtttattggtccggttctgttagccgtttcctggcgtctgtttgccgcgtgggtggaagaagtcccaccgccgacggaccaaccggaagaaattctcgaagaacttggcgaaatcgagaaatcgaataagtaatttctcatcaggcggctctgccgcctgattgttaacccctgctaattgatatttgcttgctcttccccatattttcctgcttaccgctattcagctggtagtacctgtcgcaaattctttacagtttttaaactaatgagacgaatctgatcgacgcaaaaagtccgtatgcctactattagctcacggttataaatcaacatattgatttataagcatggaaatcccctgagtgaaacaacgaattgctgtgtgtagtctttgcccatctcccacgatgggcttttttttaacatttttctgcttcgctacctcgcccctcactctttccaataatgttgcacaagatactgtgactctcttcaagccgtcagcaggctgataatgttatttatattttattgtttatttcatgcagccattacacgatgaacgcttatgaactccaggcacttcgccatatttttgccatgactattgatgaatgcgcgacctggattgcccagaccggtaacagtgaaagctggcgtcagtgggaaaatggcaaatgcgccattcctgattgtgtagtcgagcaactgttggctatgcgtcagcaacgaaaaaaacatcttcatgccatcatagagaaaataaataaccgcatcggcaacaacaccatgcgttttttccccgacttaaccgcgtttcaacaagtctaccctgatggcaattttattgactggaagatctatcaatcggtagccgctgaattatatgcacacgatctggagcggctttgttaatttctccacagaaaggaattgtcgttgttacaacaataatgaacggatactgacacaacatcgctacactttttaaagcacctttgctaagtagaacctatgaaaaatccctattaccctaccgcacttgggttgtattttaattacctggtgcatggtatgggcgtcattttgatgagcctgaatatggcctcgctggagacgctttggcagactaatgccgcgggcgtctcgatagttatctcatcactgggcattggtcgattaagtgtcttgctttttgcaggattattatccgatcgctttggtcgccgcccttttatcatgctcgggatgtgctgctatatggccttcttttttggcatcctgcacaccaataacatcattatcgcttatgtttttggctttctggcgggaatggcaaacagttttctcgatgcaggcacctatcccagtttgatggaagcttttccacgctcaccgggtacagccaatattttaattaacgcatttgtttccagcggacagtttttattaccgctaattatcagcctgttagtgtgggctgaactgtggttcggttggtcctttatgattgccgcaggcattatgtttattaacgctctgtttttataccgttgtacgttcccaccccatccgggtcgtcacttacctgccataaagaaaaccaccagctctacggaacatcgctgttcaattatcgatttagccagttattccctatatggctatatctcaatggcaacgttttatctggttagccagtggctggcacaatacggacaatttgtcgctggcatgtcatacaccatgtcgatcaaattactcagtatctacaccgtgggttcgctgctgtgtgtatttattactgctccactcattcgtaataccgttcgcccaacaacattactgatgctgtacacctttatctcatttatcgccctgctcaccgtctgcctgcatcccacattttatgtggtgataatatttgctttcgtcatcggttttacctccgcaggcggtgttgtacaaattggcctgacgttaatggcggaacgttttccctacgctaaaggaaaagcaacggggatctattacagtgcgggcagcattgcaacatttaccattccgttgattacggctcatctttcgcaaagaagtattgccgatattatgtggttcgataccgccatcgctgctatcggctttatactggcactgtttattggcttacgcagtcgcaaagaaacgcggcatcacacgctaaaggaaaatatcgctccgggtgagtaatgcaatattcttttcaggttatgcaagatcttacggataaataactctttctgcgctaactaaggaaaatcgcgatcaaaaacaaactatgacatgcaatattcctggaaacataaactttatgccatgtacccagggaaaattatcttcagtatagtaattatgtaaaccgtcggagaacaatacgtacggtaacgaaattatctttcagcaaggagctgtgaaaatgtctcaaaataaggctttcagcacgccatttatcctggctgttctttgtatttacttcagctatttcctgcacggcattagtgttattacgcttgcccaaaacatgacatctttggcagaaaagttttccactgacaacgcgggcattgcctatttaatttccggtatcggattggggcgattgatcagtattttattcttcggagtgatctccgataagtttggtcgtcgggcggtgatattaatggcagtaataatgtatctgctattcttctttggtattcctgcttgcccgaatttaactctcgcctactgtctggcagtgtgcgtaggtatcgctaactcagcgctggatacgggtggctaccccgcgctcatggaatgctttccgaaagcctctggttcggcggtcatactggttaaagcgatggtgtcattcgggcaaatgttctacccaatgctggtgagctatatgttgctcaataacatctggtacggctatgggctgattattccgggtattctgtttgtactgatcacgctgatgctgttgaaaagcaaattccccagccagttggtggacgccagcgtagctaatgaattaccgcaaatgaacagcaaaccgttagtctggctggaaggtgtttcatcagtactgttcggtgtagccgcattctcgaccttttatgtgattgtggtgtggatgcccaaatatgcgatggcttttgctggtatgtcagaagctgaggcattaaaaaccatctcttattacagtatgggttcgctggtctgtgtctttatttttgccgcactgctgaaaaaaatggtccggcccatctgggctaatgtatttaactctgcactggcaacaataacagctgccattatctacctgtacccttctccattggtgtgtaatgccggagcctttgttatcggtttctcagcagctggcggcattttacagctcggcgtttcggtcatgtcagagtttttcccaaaaagcaaagccaaagtcaccagtatatatatgatgatgggtggactggctaactttgttattccgctgattaccggttatctgtcgaacatcggcctgcaatatatcattgttctcgattttactttcgcgctgctggccctgattaccgcaattattgtttttatccgctattaccgcgttttcattattcctgaaaatgatgtgcggtttggcgagcataaatttagcacccggttaaacacaattaagcatagaggttaaaggagttaattatggatgttaccgcaaaatacgaattgattgggttgatggcctatcccatccgccacagtttatcgcccgaaatgcagaataaagccttagaaaaagcgggattgccatttacctatatggcctttgaagtggataacgatagttttcccggagcaattgaaggattaaaagccctcaaaatgcgcggaactggtgtatcaatgccgaacaaacaactggcgtgtgaatatgttgatgaattaacgccagcggccaaactggtgggagccatcaacaccatcgttaatgatgatggctatctgcgtggctataacaccgacggcacgggtcatattcgcgccattaaagagagcggttttgatatcaaaggcaaaacgatggtgctattaggggccggtggtgcctcaacggcaattggcgcgcagggggcaattgaaggtttaaaagaaattaaactctttaaccgtcgggatgagttcttcgataaagctctcgccttcgcgcagcgggttaacgaaaacaccgattgcgtcgtgacagtcaccgatctcgccgatcagcaagcctttgcagaagccctggcttccgccgacattttaaccaatggcaccaaagtgggtatgaaaccccttgagaatgaatcattggttaatgatatcagtctgttacatccgggacttctggtcactgaatgcgtgtataaccctcatatgacgaagttattgcagcaggcgcaacaagcgggttgcaaaacgattgatggatacggcatgttgttgtggcaaggggctgaacagttcacgttatggactggcaaagatttccctctggaatatgttaaacaggtcatggggttcggtgcctgacaggctgaccgcgtgcagaaagggtaaaaaatgaaaaccgtaactgtaaaagatctcgtcattggtacgggcgcacctaaaatcatcgtctcgctgatggcgaaagatatcgccagcgtgaaatccgaagctctcgcctatcgtgaagcggactttgatattctggaatggcgtgtggaccactatgccgatctctccaatgtggagtctgtcatagcggcagcaaaaattctccgtgaaaccatgccagaaaaaccgctgctgtttaccttccgcagtgccaaagaaggcggcgagcaggcgatttccaccgaggcttatattgcactcaatcgtgcagccatcgacagtggcctggttgatatgatcgatctggagttatttaccggcgatgatcaggttaaagaaaccgtcgcctacgcccacgcgcatgatgtgaaagttgtcatgtccaaccatgacttccataaaacaccggaagccgaagaaatcattgcccgtctgcgcaaaatgcagtccttcgacgccgatattcctaagattgcgctgatgccgcaaagtaccagcgatgtgctgacgttgcttgccgcgaccctggagatgcaggagcagtatgccgatcgtccaatcatcacgatgtcgatggcaaaaactggcgtaatttctcgtctggctggtgaagtatttgggtcggcggcaacttttggtgcggtaaaaaaagcctctgcgccagggcaaatctcggtaaatgatttgcgtacggtattaactattttacatcaggcataagcaataatatttcggcgggaataccctcccccgccgaactaaaaaagtatttttaaccgtatttaataaaaatatttcgtgagtctctgtgcgctaattctccatctggcgtagggaaaatcacacctgaatcaggaattaacaatgaaacctgtaaaaccacctcgtattaatggacgagtgccggtcctgtcggcacaggaagcggtgaattatattcccgacgaagcaacactttgtgtgttaggcgctggcggcggtattctggaagccaccacgttaattactgctcttgctgataaatataaacagactcaaacaccacgtaatttatcgattattagtccaacagggcttggcgatcgcgccgaccgtggtattagtccgctggcacaagaaggtctggtgaaatgggcattatgcggtcactggggacaatcgccgcgtatttctgatctcgcagaacaaaataaaattattgcttataactatccacaaggtgtacttacacaaaccttacgcgccgccgcagcccaccagcctggtattattagtgatattggcatcggaacatttgtcgatccacgccagcaaggcggcaaactgaatgaagtcactaaagaagacctgattaaactggtcgagtttgataacaaagaatatctctattacaaagcgatagcgccagatatcgccttcattcgcgctaccacctgcgacagcgaaggctacgccacttttgaagatgaggtgatgtatctcgacgcattggttattgcccaggcggtgcacaataacggcggtattgtgatgatgcaggtgcagaaaatggttaagaaagccacgctgcatcctaaatctgtccgtattccgggttatctggtggatattgtggtggtcgatccggatcaaacccaactgtatggcggtgcgccggttaaccgctttatttctggtgacttcactcttgatgatagcaccaaacttagcctgcccctaaaccaacgtaaattagttgcacggcgtgcattattcgaaatgcgcaaaggcgcagtggggaatgtcggcgtcggtattgctgacggcattggcctggtcgcccgggaagaaggttgtgctgatgactttattctgacggtagaaacaggtccgattggcggtattacttcacaggggatcgcctttggcgcgaacgtgaatacccgcgccattctggatatgacgtcccagtttgatttttatcacggtggtggtctggatgtttgttatttgagttttgctgaagtcgaccagcacggtaacgtcggcgtgcataaattcaatggtaaaatcatgggcaccggtggatttattgatatcagtgccacttcgaagaaaatcgttttctgcggcacattaactgcgggcagtttaaaaacagaaattaccgacggcaaattaaatatcgtccaggaaggacgggtgaagaaatttattcgggaactaccggaaattactttcagtggaaaaatcggtaatgactccaacttattgatagtgttttatattcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagcctgtcatacgcgtaaaacagccagcgctggcgcgatttagccccgacatagccccactgttcgtccatttccgcgcagacgatgacgtcactgcccggctgtatgcgcgaggttaccgactgcggcctgagttttttaagtgacgtaaaatcgtgttgaggccaacgcccataatgcgggcagttgcccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggaccgctgatagaaacagaagccactggagcacttcaaaaacaccatcatacactaaatcagtaagttggcagcatcaccgaaaaatcgctctcaagcgagggctggatgttcgttatatcactgagcgcgccgtattcacgctaaaagaagacggcctgcatttaatcgaaatcgctcctggcgtcgatttacaaaaagatattctcgacaaaatggatttcaccccagtgatttcaccagaactgaaactgatggacgaaagattatttatagatgcggcgatgggttttgtcctgcctgaagcggctcattaacaggagtataatgatggatttttctttaactgaagaacaagaactgctgctggccagtattcgcgaactgattacgactaactttccggaagagtatttccgcacctgcgatcaaaacgggacatacccgcgtgagtttatgcgggcactggcggataacggtatttccatgcttggcgtgccggaagaatttggtggtatccctgcggattacgtcacccaaatgctggcgctgatggaagtgtcaaaatgcggtgctccggcatttttgattaccaacggtcaatgtattcacagtatgcgccgtttcggttctgcagagcagctacgtaaaacggcagagagcaccctggaaacgggtgatcccgcctatgccctggcattgacggagccaggcgcaggctcagacaacaacagtgccactaccacttacacgcgtaaaaacggcaaggtttacatcaacggacagaaaacctttattaccggtgcgaaagagtacccatatatgctggtgttggcgcgcgatccgcaaccgaaagatccgaaaaaggcctttactctgtggtgggtcgactccagtaaacccggcattaaaatcaatccactgcataaaatcggctggcatatgctcagcacctgcgaagtctatctcgacaacgtggaagttgaagagagcgacatggtgggcgaagaaggaatgggtttcctcaatgtgatgtacaactttgagatggagcgcctgatcaacgccgcgcgcagcaccggctttgccgaatgcgcattcgaagatgccgcccgctatgccaaccagcgtatcgcttttggtaagcccattggtcataaccagatgatccaggaaaaactggcgctgatggcgattaagatcgacaacatgcgcaacatggtgttgaaagtggcatggcaagccgatcagcatcagtcactgcgcaccagcgcggcgctggcaaaactgtactgcgcacgtaccgcaatggaagtcattgatgatgcgattcaaatcatgggcggtctgggctataccgatgaggcgcgcgtctcccgcttctggcgtgatgtccgttgtgaacgtatcggcggcggtacagacgaaattatgatttacgtagcaggtcggcagatcctgaaagattatcagaacaaataatctgcaggcggcgcagcttcttaacaaactgcgccgccagatttatccggcaagacttactggttgaggaaattcagataggatttcttgttccgcaaaacagtttttaaattgcctgcggtaatcgctgggcgaacagccgacatggcgcaaaaacagtttggcaaagtgatcgacattttcataacccacacgccaggaaatctctgcctgtgataattcagtattagtgagtgaccatttcgcttccgtcatacgccgttgaataacatagttaataggggaaatacgatactctttggtaaattcatggcagatataactgacgctggcacgaaattttttcgataactgctctaaagtgattttttcgcgatagttattattcagatagaaaagaatatcttttatcagaacatcttttttaatatatccctgctccgaacgataagcatttttaaagttttcgtagtaaagaattgctaacgtataggcaaatgcgtcccataacgaagatgtttggctatttttactttgcggcaaaatcacacttagctcattaaataaggttttaatgacttcttttccctgccctgcggcaattaccgggcaagaatgcggttgcagtagctgattttcctcagccccctgaaactgaaagccgtacagcgcacaggtacacgtcgttgccggatcgttaacgtcagaggccaccgcatgcagcctgccacgttctatcaccacaatgtcatcggcatgcgcgacatataacgaagaatcgatggtaaaccttgctacccctttcttgacgtaaatcagctcggtttcattgtcatgaacgtgatgtccagactcccattttggatcatcgctaaatgcgaaacgtgaaagccgtggcgttttaccggcgacaaacagcgtttcactggcattatcaaaacagcgttgatacatgacaacctccctattccatgagcaaacaaaaacaatatatgccggataaaatacggcgtgtattgcggttatacaaccgcgtttagcgagagctaaacaagattatttacactgaatgcaagattgcacggtcatggaataactatattgccgcaaattgcacttttgttttagcgatcgcattttttttgcaagattgttggcaaggaaaacagcttgctccgtcgaaaaccccgcaccgctatcgcacactattttcaggccatttttaccttccatcggagatggttccgtatgcgactcacaggagaaatcatgaaaataataacctgctttaagctggtgcctgaagaacaggacattgttgtcactccagaataccccctgaatttcgacaatgccgacgccaaaatcagccagttcgatctcaatgccattgaagctgcaagccagcttgcaacagatgacgatgagatagccgcgctgaccgtcggcggctctttgttgcagaactcgaaagtgcgcaaagacgtgctatcccgcgggccgcacagcctgtatatggtgcaggatgcacaacttgagcatgcactgcctctcgataccgcaaaggcgctggcgacagcagttgaaaagatcggcttcgatttactgatctttggtgaaggttccggcgacctttatgcccagcaggttggcttgctggtcggagaaattctgcaacttccggtgattaatgcagtgagtgccattcagcgtcagggcaatacactggtgattgaacgcacgcttgaagatgatgttgaagttattgaactctctgttccagccgtgctctgcgtcacctccgatattaacgtgccacgtattccttcgatgaaagccattctcggcgctggtaaaaaaccggtaaatcagtggcaggcaagtgatattggctggagccagagcgcaccacttgctgaactgaccggcattcgcgtaccgccgcaaacagaacgtaagcacatcattctcgataacgattcgccggaggccattgccgagctggcggaacatctgaagaaagccctgaactgaagcctacggagaagaaacgatgagtcaattaaacagcgtctgggtctttagcgataatcctgaacgttatgctgaactgtttggcggcgctcagcaatggggccaacaggtgtatgccattgtacaaaataccgagcaggcgcaggcagttatgccttatgggccaaaatgcatttatgttcttgagcaaaacgacgcgctgcaacgtactgaaaattacgccgaaagcattgctgccctgctgaaagataaacaccccgctatgttgctgttggccgcgacgaaacgtggtaaagctctggcagcacggttaagtgtgcaactgaatgcggcgctggtgaacgatgccacggcggtggatattatcgatggtcacatttgcgccgaacaccggatgtatggcgggttagcgttcgctcaggaaaagatcaacagcccgctggcgatcattacccttgcacccggtgttcaggagccgtgcacccgtgatatctctcatcagtgcccgacagaaacggtaccttatgttgccccgcgtcatgaaattctctgtcgcgaacgccgtgcgaaagcggcaagcagcgtggacctgagcaaagcaaaacgtatggttggcgtcggtcgtggtctggcggcgcaggatgacctgaaaatggtccacgaactggcggcggtgctgaatgctgaagtcggctgttcacgtccaattgccgaaggcgagaactggatggagcgtgaacgttatatcggtgtctccggcgtgttgctgaaatccgatctctacctgacgctggggatctccgggcagatccagcatatggttggcggcaacggcgcaaaagtgattgtcgccattaataaagataaaaatgcgccaatcttcaactatgccgactacggtctggtgggcgatatctacaaagtcgtccctgccctgattagccagttgagtcgctaattccctttcaaccacatctcccgctgtaaacgcagcgggaagggagcataacgcatgtcggatgacaaatttgatgccattgtggtcggtgcgggcgttgccggtagcgttgccgcactggtcatggcgcgagccgggctggatgtcctggtgatagaacgcggcgacagtgccggatgtaaaaacatgaccggcgggcgtctttatgcccacacactcgaagcaattattccaggctttgcagcatcagcgccgatagaacgcaaggtcacacgcgagaaaatctccttcttaaccgaagaaagcgccgttaccctcgattttcaccgcgagcaaccagatgttccgcaacacgcgtcttataccgtattgcgtaatcgtctggacccgtggttgatggaacaagccgagcaggcgggcgcgcagtttatcccgggcgtacgcgtcgatgcgctggttcgtgaaggaaacaaggtcactggcgtccaggccggggatgatattctcgaagcgaatgtggtgattctggctgatggcgttaactcgatgcttggccgctcgctgggaatggtttccgcttccaatccgcatcattacgctgttggtgttaaagaggttataggcctgacaccagaacagatcaacgatcgctttaatgttacgggcgaggaaggtgccgcctggctgtttgccggttccccttctgacggcctgatgggcggcggattcctctataccaacaaggattccgtatcgttggggctggtttgtggattgggtgatatcgcccatgcgcaaaaaagcgtgccgcaaatgctggaagattttaaacaacaccccgccattcgcccgctgattagcggcggcaaactgcttgaatattccgcgcatatggtgccggagggcggtctggcaatggtgccgcagctggttaacgatggcgtgatgatcgttggtgacgccgcaggcttctgcctgaatttgggttttacagttcgcggcatggatttagccattgcatcagctcaggctgccgccacaacggtgatcgccgccaaagaacgcgcggatttctccgccagcagtctggcgcaatacaaacgtgagctggaacaaagttgtgttatgcgcgatatgcagcatttccgcaagctcccggcgctgatggaaaacccgcgcctgtttagccaatacccacgaatggtcgccgacatcatgaacgatatgttcaccattgacggcaaaccaaaccagccggtacgcaaaatgatcatgggacacgcgaagaaaattgggctgatcaacttgctgaaagatggcattaagggagcaaccgcgctatgagccagaacgctacggttaacgtcgacatcaaattaggcgtcaataaattccatgttgatgagggccacccgcatatcattttggcggcaaatcccgatatcaatgaattccgtaaattaatgaaagcttgccctgccggactttataagcaggatgacgcaggaaacattcatttcgattccgccggttgtctggagtgcggcacctgtcgggtgctgtgcggcaacactattctcaaacagtggcaatatcccgcaggcaccttcggtattgaatttcgctacggctaatcatgcatcccacaggcccgcatctcgggcctgatgttctgtttcgagagtccaaaatgaaagtgacattaacgttcaacgaacaacgtcgtgcggcgtatcgtcagcaagggttatggggcgatgcttcactggccgattactggcagcagaccgctcgtgcgatgccagacaaaattgccgtggtcgacaatcatggtgcaacgtacacctatagcgcgctcgatcacgccgcgagctgtctggcaaactggatgttagcgaagggtattgaatcaggcgatcgcatcgcatttcaactgccaggctggtgtgaatttaccgttatctatcttgcctgcctgaaaaccggtgcggtttccgtgccgctgttaccttcctggcgggaagcagaactggtgtgggtgctcaataagtgtcaggcaaaaatgttctttgcaccgacgttgtttaaacaaacgcgtccggtagatttaatcctgccgctgcaaaatcagcttccacaactacaacaaattgtcggcgtggacaaactggctcccgccacctcttccctctcattaagtcagattctcgccgacaatactcctctgaccacggcgataacgacccacggcgatgaattagccgctgtgctatttacctccggaaccgagggtctgccaaagggtgtgatgctaacgcataacaatattctcgccagtgagcgggcttattgcgcgcggctaaatctgacctggcaggatgtctttatgatgcctgcgccacttggtcacgcaacgggctttctgcatggcgtaacagcaccttttttgattggtgctcgcagcgtgttgttagatattttcactcctgatgcgtgtctcgcgctgcttgagcagcagcgttgcacctgtatgctcggcgcaacgccgtttgtctatgatcttttgaatttactagagaaacaacccgcagacctttcagcgctgcgcttctttctttgcggaggtaccacaatccccaaaaaagtggcgcgagaatgccagcagcgcggcattaaattattaagtgtttatggttccacagaaagttcgccgcatgcggtggtgaatctcgacgatcctttgccgcgctttatgcacaccgacggttacgctgccgcaggtgtagagattaaagtggtcgatgacgcacgcaagactttaccgccaggttgcgaaggtgaagaagcctcgcgtggccccaatgtgtttatggggtattttgatgaacctgaattaaccgcccgtgccctggatgaagaaggctggtattacagcggcgatctctgccgcatggatgaggctggctatataaaaataaccgggcgcaagaaagatattattgtccgcggcggcgaaaatattagcagccgtgaagtagaagatattttattgcagcatcctaaaattcacgatgcctgtgtggttgcgatgcccgatgaacgtttaggtgaacgttcatgcgcttatgtcgtgctgaaagcgccgcatcattcattatcgctggaagaggtggtggctttttttagccgtaaacgggtcgcaaaatataaatatcctgaacatatcgtggtaatcgaaaaactaccgcgcactgtctcaggtaaaatacaaaagtttttgttaaggaaagatattatgcggcgattaactcaggatgtctgtgaagagattgaataagtttcatcttcggggatcacataaacccggcgacaaaacgccgccgggtatttattttatttcttcagttcagccaggcttaaccaggtttgcaccacggtgtccgggttcagagacaggctatcgatcccctcttccatcaaccatgcagcaaagtcttcgtggtcggatggaccctgaccgcaaatcccgacatatttgccctgtttcttcgcggcacgaatcgccatcgacagcagtgctttcaccgcatcgttgcgctcatcgaacagttcggacaccacgccggagtcacgatccagaccgagcgccagctgcgtcatgtcgtttgagccaattgagaagccgtcgaaatattccaggaactgctctgccagcaaggcgttggacggaatttcacacatcatgatgattttcagcccgttctcgccacgtttcagcccctgacgcgccagttcctcaaccaccgctttcgcctgatcaacggtacgcacgaacgggatcatgatctcaacgttagtcagccccatgtcgttgcgtacacgtttcactgcttcacactccagcgcgaagcagtcgcggaaggtgtcggaaacatagcggcccgcgccacggaagccgagcatcgggttctcttcatctggctcgtaacgctcaccaccgaccagattggcatattcgttcgatttaaaatcagagagacggacaatgacgcgcttcggataaaacgcggcacccagcgtcgcgatcccttcagtcagacgaccaacgtaaaattcacgcggagaatcaaaacctttcatcatctcgcggatttcgttttgcaactgcggttcctgatcgtcaaactcaagcagtgcgcgtgggtggacgccaatcatacggttgatgataaattccagacgcgcaaggcccacgccttcgttcggcaggcaggcgaagtcgaaagcacggtccgggttaccgacgttcatcatcaccttcaacggcaggtccggcatcgtttctacgctggagcttttcacgctaaattccagcaacttcgcatagacgtaaccggtatcaccttcggcacaagaaacagtgacgttctcgccgtctttcatccgttctgttgcatcaccacagcccactaccgccggaatgccgagttcacgagcgatgatcgccgcgtgacaggtacgaccgccacggttggtgacgatggcagatgctttcttcatgatcggttcccagtccgggtcggtcatgtcagtaaccagcacgtcgccaggttcgatgcggttcatttcgctgatgtcatggatgactttcaccggccccgcgccgatgcgatgaccaatagcacggccttcggcgataatcttaccctgtgaatgcagcgtataacgctccatgacctgaccgcgtgagcgcacggtttccggacgcgcctgcacaatgaacagtttgccggtgtggccatctttcgcccactcaatatccatcgggcgaccgtagtgtttctcaatttgtacggcctgttttgccagttcctgcacttcttcgttggtcagcgagaagatgtcacgctgttcctgcggtacgtcttcgattttaacctgcttgccgtgctcctgggtcggcgcgtaaaccatgcggatttttttcgaccccatggtgcggcgcacgatagccgggcgattcgccgcaagtgtcggtttatgcacataaaactcatccgggttaaccgcaccctgcacgaccatttcaccaaggccccatgcggaagtgataaacaccacctggtcaaagccggattcggtatcaatggagaacatcacgccagaagatgcgaggtcggagcgcaccatccgctgaacaccggcggagagcgccacgccacgatggtcgtaaccctggtgcacacgataagagatggcgcgatcgttaaacagagaagcaaatacatgcttcactgccacgagaacggcgtcaaaaccctgaacgttgaggaaagtttcctgctgaccggcaaaagaagcgtccggcatatcttctgcagtagcggaggaacgcaccgcaaacgaagcgttttcgtcatcggcggaaagctgtgcataggcttcgcggatggcgttttccagctcaggctggaagggagtgtcgataatccactggcggatttgcgcgcccgctttcgcaagctgggtaacatcgtcaatatccgttttatccagcagttcataaatgcgctggtttacgccgctttggtccagaaactggttaaacgcgtcggcggttgtggcgaaaccattcggaacggaaacacccattccggaaaggttagtaatcatttcacccagggaggcatttttgcccccaaccctgtctacatcattcatgccgagttggttataccaaagcaccagcggtgacgagccattgttggacatcgaacaatccttttgtgataaatgaacggtttgagaaacacatttctgcgcatttatctttgcatatttaaccggatgaaaaaaacggtgaatcgttcaagcaaatatatttttttactttttaagactgatcccagcgttgcgcaaatctgctctcttcgacaatttccacataaaccatcggtataaacgaaaccataaaaatgaaatgctgttttcataaaaaataaaatttaagtttcattttataaaccagacataacgttctacgcttctgtgcgtttttaatttatgctttcatagaattatgtctgcatcacgggaagaacaaaatggataatgctgttgatcgccacgttttttatatttctgatggtacggcaataactgcggaggtattaggacacgcagtaatgtcacaatttcccgtcactatcagcagcattacgctgccgtttgtcgaaaatgagagccgtgcacgggcagtgaaggatcagattgacgcaatttatcaccagacaggtgtgcgcccgctggtcttctactccatcgtgttgccggagattcgcgctatcatcttgcaaagtgaaggcttttgccaggatatcgttcaggcgctggttgccccgctacaacaagagatgaaactggatccaacgccgattgctcatcgtacccatggccttaaccctaataatctcaataaatatgatgcgcgcattgcggcgattgattacacccttgcccacgatgacggtatttcgttgcgcaatctggaccaggctcaggtgatcctgctcggtgtttctcgctgtggtaaaacccccaccagtctgtatctggcaatgcaatttggtatccgcgcggcaaattacccctttattgccgacgatatggataatctggtgctgcccgcgtcgctcaaaccacttcagcacaaattgttcggcctgactatcgacccggaacgtctggcggcgattcgcgaggaacgtcgggagaacagccgctatgcctcgcttcgtcagtgcaggatggaagtcgcggaagtggaagcgttgtaccgtaaaaatcagatcccgtggattaacagtaccaattattcggtagaagagattgccaccaagatcctcgatatcatgggccttagccgccgaatgtactagagaactagtgcattggcttacttttttgttatcatgctaaccacccggcgaggtgtgacacacctcgcacttgaaatcagctgcgattggtttatcgtgatgcgcatcacttcccggtagtcctgccgtagaagcaacaaatttctgagacttgtaatgaacagaactgacgaactccgtactgcgcgtattgagagcctggtaacgcccgccgaactcgcgctacggtatcccgtaacgcctggcgtcgccacccatgtcaccgactcccgccgtagaattgaaaaaatactgaatggtgaagataagcgactgttggtcattattggcccctgctcgatccacgatctcaccgctgcgatggagtacgccacccgtctgcagtcgctacgcaaccagtaccagccacggctggaaatcgtaatgcgcacctattttgaaaaaccacgaacggttgtcggctggaaaggactcatctccgatccagatttaaacggtagctatcgggtaaatcacggtctggagctggcgcgcaaattacttttacaggtaaatgagctgggcgtccctaccgcgactgagttcctcgatatggtgaccggtcagtttattgctgatttaatcagttggggcgcgattggcgcacgtactaccgaaagtcagatccaccgcgaaatggcttcggcactctcctgtccggtgggttttaaaaatggtaccgatggcaacacgcggattgccgtggatgctatccgcgcagcccgcgccagccatatgttcctctcaccagacaaaaacggtcagatgaccatctatcagaccagcggcaacccgtatggccacattattatgcgtggcggcaaaaaaccgaattatcatgccgatgatatcgccgcagcctgcgatacgctgcacgagtttgatttacctgaacatctggtggtggatttcagccacggtaactgccagaagcagcaccgtcgccagttagaagtttgtgaggatatttgtcagcaaatccgcaatggctctacggcgattgctggaattatggcggaaagtttcctgcgcgaaggaacgcaaaaaatcgtcggcggtcagccgctcacttacggtcaatccattaccgacccgtgtctgggctgggaagataccgaacgcctggtcgaaaaactcgcctctgcggtagatactcgcttctgaatgcgtgcccattcctgacgggatgggcatttctgcgcaacttgttgtcttctcaacaaattactacttgctctggcccgccataatattgataataagaatcattgttatataaattattattaatttttatgcgttatacggatagcagaaaactcacgcctgaaacggatgccagtcacaagaccgcttccccgcagcccatccggcgaattaccagccagacactgttaggtccggatggcaaactgattatcgatcatgacgggcaagaatatctgctccgtaaaactcaggctggcaagctgctgttgaccaagtagcctttaactcgagcagctgacttccagccgtttaccccagtcgggtggacgactgacatagtcatcatctctgtcgctgaaaggatttcgcaacgcctcatgcaggcggtgcaattccgtcatatcacccttttctgccgcttcaatcgcccgttgcgccaaccagttgcgcaacaccagagccgggttaacgctttgcatcagctgctgacgctcactatcggtaacctcgtcttgttgcaaacgtacccgataacgggcaaaccagtcatcaaatgccgcacgatcgataaactcatcacgtagcggtgacgccgcgctgtgctgctcggtcagactcagcatgcggaatgtgcgggtataatcgctgcgctctcgcgccatcagactgaataattcattaagtagcgcgttatcctctttttgctccgtcatgaagcccagtttctgccgcatccgttgtccataatgcgtcaacaaaacctgctgatagctgtccagggcctcattcaggccatctacggcaacaaatggcgacaatgtctgcgccagacgctgtaaattccacaacgcgacggcaggttgattatcaaagctgtaacgcccttgatgatccgagtgattacaaataaaaccgggttcgtaatcatcaagaaaaccaaacggcccgtaatcaagcgtcagccccagcagcgacatgttgtcggtattcatcaccccatgagcaaagccgaccgtctgccattgggcaattaacgaggcggtacgtgcgacaacatcggtaaaccagagacggtatttgtcctcctcatcatcaagatgtgaccagtaatgacgaatggcaaagtcagctaactgacgaaccttttccggctcgcggcgatagtaaaaatgttcgaaatgaccaaagcgcagatgacttggtgccacacgcatcagcatcgcgcctgactccaccgtttcccgatacactggcgaatcgctggtgacgatacttaaagcgcgggtcgtcggaatgcccagataatgcatcgcctcactggcgagactttctcgtatcgtcgaacgtaaaaccgcccgtccatcacccattcgcgaataaggcgtcaggccagcacctttcagatgccagtccattgtagtgccatcagcaagcagttgttcgccgagtaaaatgccgcgcccatcacccagttggcccgcccagacgccaaactgatgaccactgtaaacctgcgcaagtggtgacataccaggcagtagggtttcgccgccccagacacctgcgccatttttaaacagcgacgatggaatactcagcgtgttagccagttcggtattatgccaaatcagccgggcattatttaaaggcgtaggggaaagtgctgtataggtttctggcaattcatcgcgccagcgggtaataaaagacagggtcatagatcctcctgtttgatagtgtagacggttactctcgtcttaaacaccagcaaacaggagggttatcgctgaaccaacgtcgttatctgatttataggaaccgcaggccacaggcatccctggagagcatggaaatcaaaggggataatctgtgccaatatttctggcgtatcaatgccccccgcgatgatgcaattgcaacaaggggaaatttgcgcctggatcgcacgaataaacggttcgaaggagcgatgagtgatttgttgctgaataaaacttttatccagcatgacgcgggtgaaaagaccatcaaacaccgctttcattgtgctattacctgctcccaaattacctaacacaaggggatacatttgcgataaggataaaagatcgcgattatcttttccttcattgaaatgcgggtaattctcattaatcaacagttcaataaacggatattttaatagttcgcctgcgaaattatccctgtctaataataatgtagccacttgtggcgttaaattaagccaggcaaagagtttatgttgaataaaaaagtgttggcatgattttagtaattccaactgttcagaaaataattgccaatgttgctccacggtaagttgcgctataacccgactcgtcgggatacgaaccgtaccatcttcactggagaaatgggtaattaactcaacgccgacaaggtcttgctggttatctcttatcggcaggaaatagcaatcagaatgataaagattctccaaaaaaatcttcatggtaaccttccctctcgaaggatgtttttcagtatccggctaaaagggatgaggccataagacataacaattacagaaggagtaactttcatttgttccatgttaaccactttttcaggggtcctttttttagattatcctgattataaacgaagaatccatttacggaatttttgtctgcaaaatactactgtattcaggagtaaatggacggcgatgtatcatcgccgtccatttttcgacatactagattcgtctcgcctgccagaaatttttctgccaatagacattatcaagtgaggaacgcatcactcccttgctggtagaggcgtggataaattggttgttggtatcgtaaatacctacatgcaaaccattttgtccggaacccgttttgaaaaagaccaggtcacctggcagcaactcgtctttatcaatttgcgtgccaatagaggcttgttgtttggtttcacggggcagctgcaaatcgaaacgatcgcgcatcgtcacaaccacaaatcccgaacagtccacaccgcgccgcgtcatgccaccataacgatacggcgtgccatgccagctttgtagctggtcgttcaaaccggcaataacggtaatcgaatcagaaagtctggcatttggcggcggtgctttatggtggctacacccggccagaaacagtgctgtgatcaaaataaggcagaaacgcattccgtacggttcctctgttttttattcttgcattaatttagcgtcgtaattacccgattttcaagatactaatgaaatcagatggtcgaaatcagcattctgtgaccttcgatatccagacggcgaaaattcatcccataggcctgcgccagatttgccggcgtgagcacctcttctctgcgtccactggccagcatttttccaccttttagcaaccacgcccgatgcgcatgacgcaatgtgtggttgagatcgtgactgctcatcacaatcgccagtccttgctgacacagcgcgctcagaattttgtctaaggcactttgttgcgcaacatcaagactgttcatcggctcatcaagaagcagcaattggcctgcgggattggcttgtggtgtgatttgcagcaccaccgcagcaagacgtacgcgttgccattcaccgccggaaagttgattggtgctacgtccgagtttgtcatcaagagccagcgcccctgcgacatcattcagtagttcggtacgcgttttatcgtgctgatgcagtgtcaggtagtgccagaccggcattgcaaacggcggcgtctgctgttgtgaaagataggcgcgatgcagcgcgagctttgttgcagaccatgcttccagtggttgccccgcgaactgaatgcttcccttaccgctggtcattccggccattcgcgccagtaaggtactcttacccgcgccattcggccccaccaggtgcaggatctccccagcccgaacctcgccagaaagcggccccaggcgggtagattccgcaacatcctgtaactgcatcacaatagacattattttgccaacgccagtttaatgctttccatcacaatgggatcttccggcgtcatatccggggaaaaacgctggatgaccaatccgtccctgccaactaaaaatttctcaaaattccataaaatatcatcagggtacagcggtgcacgacctttgctgaccatacgggcatagaatccgctctcttccggcgcgactgcagtcggcgctgcggcaatcaatttttgatacagcggatggcgtccttcgccattaacttcaatcttactgaacatcgggaacatcaccccccatgtggtggtgcagtaagttttaatctcttcatcgctacccggttcttgctccagaaactggttacacgggaatcccagcaccacaaaaccacgatcagcccaggctttctgaatattctccaactgctcatattgcggcgttaagccacactttgaggcgacattgacaatcaacagcacattaccggcgtacttctccagcgtggtcacttcaccgtcgatatctttcactacggtcgtcagaatggaatcttgcatcgtttctcctgggtgtggtcagtaaaaatcttagcttttaatcatagaccgtcttttgcggctaacgtcctgcttttaacaataaccagataaacaccggcgcacccaacgttgcggtgaccacgccaattggcagctctgcggcagctaatgccaggcgcgctacaatatcggccagcagcaatgcgctcgcccctgccagcgcgcagccgggaagtaatacgcgatgatcggttaaaccacacagccggagaatatgtgggatcaccagaccaataaagccgatagcacccgccagcgccacactgacgccaaccatccagccggtcgctgccaccagcacattgcgccagaaccacaggggtaaacccagttgccgcgccgagatctcgccaagtgctaacatattcatcggcctggactgacaacagatccacaacaacactgggatcaatgccagcatcagccagctttgccgccagtctacgccgccaaaaccgcccatcatccagtacatcagctgacgtaaatcaacagaggtggaaaagtagatagcccacgtcattagtgcgctacagataatccctaatgcaacgccagccagcaataaccgactggtcgaaagatgacgacgagcgaaacgtaagagtattaaagtgatgataagcgcgccagcaatcgcacacagccctagcgcccagttggggagttgcccttgcccaagtaataccgcggcgataagccccacgcctgcgccgttagagacgccaagtagtccaggttctgccagaggattttcaaacaacgcctgcattacagcgccggatatagccagcgccgcaccaaccagcaatacagccagcgtacgtggcaggcgaatttgccagacgaacagttcgccacgaggagaaaaccagtcacctggcaaaatccattgttcaccggcgcaaaggcttaagagaagcgccagcagcatcaaaactgacaggcataataaccagcgaatattttgtcgctgttgttggcgggcaagtgtcagcatggtatccgttctgctgaagtgtcatggcgttgattttacggtgactcttcgacagtgaaaagaaaaaaggccgcagagcggcctttttagttagatcagattactcgtctttgggcgaagcgttttcgacccggctttttaacttctgcccgggtctgaaggtcaccacgcgccgtgctgtaatgggaatatcctcgcccgttttcgggttacgtcccgggcgttgattcttatcacgcagatcgaagttaccaaaaccagagagtttcacctgttcgccgttttccagagcgcgacggatctcttcgaaaaacagttcaaccagttctttggcatcccgcttgctaagcccaagcttatcaaacagatattctgacatttcagcttttgtaagcgccataggttcaatccctcaatgatgcctggaatcgctcttttaatgcctctacacatttggcgacggtagcggcaatctcctcttcttcgagtgtacggctggtatcttgcaggatcaggcttatggcgaggctcttatacccctccgcaacacccttaccgcggtacacgtcaaataagtttacgccaactacctgatttacgccaactttcttacattcggataaaatatccgctgcgggaacgttttctgcgaccaccaccgcgatgtcacgacggttcgccgggaagcgagaaatctcgcgcgcctgaggcaccacgcggtctgcgagcttgttccactccagttcgaacaccagagtgcgaccgttaagatccagtttacgttccagttcaggatgaacaaccccaacaaaaccaatacgttcacctttcagataaatcgctgcggattgccccggatgcagtgccggattcgcttctgcacggaactcaacctcattcagtttaccggtcaggtcgagaacggattcaagatcgcctttcaaatcatagaaatcaacggtctcttttgccaggttccagtgctcttcgtaacggttaccgcaaatcacaccggctaacatcagatcctgacgaatacccaacggtgcctgagtatctggcacgaaacgcagaccgctttcgaaaatgcgtacacgattctgctgacggttctggttgtacaccacggttgccagcaggccggtccacagggaaagacgcattgctgacatttcaacagagatcgggcttggcagcagtaaggcttcaacgcctggatggatcatctgctgcactttcgggtcaacgaagctgtaggtgatcacttcctgatagcctttgtcgttgagcagcgtttttacgcgcttgagcgacaggtcagcttcacggtgagtccccataatcaggcttgcctgtaccggctcatccgggatgttgttgtagccgtaaacacgcgcgacttcttcgaccagatcttcttcaatctccatgtcgaaacgccagctcggcgcaactgcctgccactcgtctttgccttcggtcacttcgcagccgagacgacgcagaatgtctgttacctgctcatcagcaatatgatggccgatcaggcgatccagtttgctacgacgtaaagtgatggttgcacgcttcggcagcgttgcttcgttagtgatatcaattaccggacccgcttcaccaccgcagatgtcgatcagcagacgggtcgcacgttccatcgctttgtgctgcagtgccggatcaacgccacgctcataacggtgagacgcatcagtatgcaggccatgacgacgagcacgaccggtgatagacagcgggctgaagaaagcgcattccagcagaacgttttgcgtttcgtcattcacgccagagtgttcgccaccaaatatgccgcccatcgccagcgccttgttgtggtcggcgatgaccagggtgtcagcatccagcttcgcttcagtgccgtcgagcaacaccagcgtttcgccctctttcgccatccgcaccacaatgccgccttcaatgcgatctttatcgaaagcgtgcattggctggcccagttcgagcagcacatagttggtgacgtcaacaactgcatcgatagaacggatcccgcaacgacgcagtttttctttcatccacagcggagttggcgctttaacgttaatgccttttaccacacggccaagatagcgcgggcaggcatccggcgcttctactgcaatcggcagcgtgtcgtcgatggtcgcaccaaccggaacgatttccggttcaaccagcggcagctggttcaacacggcaacgtcgcgcgcaacaccaatgatacctaagcagtcggcacggtttggcgtcacgctaatttcgatggtgttgtcatcgagtttcaggtattcgcggatgtcggtgccaatcggcgcatccgcaggcagctcgataatgccgttatgatcgtcagaaattcccagctcagagaaggagcacagcatcccttcagacggttcgccacgcagtttcgcggctttaattttgaaatcacccggcagaacagcaccaatggtcgctaccgccacacgcaggccctgacggcagtttggcgcaccgcagacgatgtccagcaggcgatcgccgccgacattcacttttgtcacacgcagtttgtcagcgttcggatgctgcgcacactcaaccacttcaccaacgaccacgccgtggaagctaccggcaaccggttctacaccatcaacttccaggcccgccatcgtgatttgatttgccagcgcgtcgctatcaatcgccgggttcacccattcgcgtaaccacagttcactaaatttcataatctattcctgccttatttaaactgtttgaggaaacgcagatcgttttcgaagaatgaacgcaggtcggtgacgccgtaacgcaacatggtcagacgctccatccccatcccgaaggcaaaaccagagtaaacttccgggtcgatgccaacgttacgcagcacgttcggatgcaccatcccgcagcccagtacttccagccatttaccgtttttccccatgacgtccacttctgcagaaggttcggtaaacgggaagtaggaaggacggaagcggatctgcaaatcttcctcaaagaagttacgcaggaagtcgtgcagcgtgcctttcaggttggtaaagctgatgttggtatcaacaatcagaccttccatctgatggaacatcggcgtgtgagtctggtcgtagtcgttacgataaacgcggccaggcgcgatgatacgaatcggtggctgctgggctttcatggtgcggatctgtacgccagaggtctgggtacgcagcaggcgggtagcgtcaaaccagaaagtgtcgtggtcagcgcgcgccgggtggtgaccaggaatgttcagagcatcgaagttatgataatcgtcttcgatttccggcccggttgccacggtaaagccaagctcaccgaagaaactttcgatacggtcgatggtacgggtcaccggatgcagcccaccgttttcaatgcgacgacccggcagggagacatcaatcgtttccgccgccagacgcgcattcagtgcggcgctttccagttccgctttacgcgcattcagcgcctgctgaacctgctctttcgcttcgttgataaccgcaccagctgccggacgctcttctggcggcagctcacgcagggtcgtcatctgaagggttaagtgcccttttttacccaaatattcgacgcgcacattatctaacgcggcaacatctgacgcctggctaatggccgccttcgcactggcaaccagttctgcgagatgtgacatgtttttcctcattgtgtcagtggtgacactggttcgttggacttagagcccatcccatcaggctattttacttgccattttggtcccgggcagtgctcgaaatcctcacgtacttaagtacgctccggtttctccgcgctggccgtgtccagactggctgcgacaattacgcctgatgagacaggctttttatttttcaaaacgcgcatacaaaaaaagcctccactgggaggctttcaggcgctgttttccgtttctcttctcacgcgctagcctcctggagtcaggtgctaaagtaaaaaaagaagcggaaaatagcagcattcattgcttgcgttaccttttggtactcttcaaaagacctttattgaaaaggctacggcgataaaagtcaatgttttgatggcgttgaaacgaaaagagggagactagctccctctttcaactggcttatgccagagctgctttcgctttttcaaccagagcggtgaacgctactttgtcgaatactgcgatatcagccaggatcttacggtcgatttcaacagaggcttttttcaggccattgatgaatttgctgtaagaaataccgttctgacgtgctgctgcgttgatacgcgcaatccacagttgacggaactgacgcttacgttgacgacggtcgcggtaagcatactgaccagctttgataacagcctggaaggcaacgcggtatacgcgagaacgcgcaccgtagtagcctttagcttgtttcaaaattttcttgtgacgtgcgcgtgcaataacaccacgttttacgcgagccatatgtgctctcctgtatctatattctaattaaaaagttaaaaacgttaacggcttatgcgtacggcaggcacgcgattaccaggcccagatcgcctttggaaaccatggctttcggacgcaggtgacgtttacgtttggtcgcttttttggtcagaatgtgacgcaggttagcgtgcttgtgcttaaaaccacctttaccggtttttttgaagcgcttagcagcaccgcgtacggtcttaatttttggcattttaataacttccacttcgcattgttaataaacgaaacaaaggcgaacaaagcctgtgaagcccgaaggctccacagacagtgctacttgaaggccttactgtttcttcttaggagcgagcaccatgatcatctggcggccttcgatcttcgttgggaaggattcgaccactgccagttcttgcaaatcgtctttcacgcgattaagcacttccataccgatttgctggtgcgccatctcacgaccgcggaaacgcagcgtgattttggctttatcaccctcttcgagaaagcgaatcaggctgcggagttttacctgatagtcgccttcatctgtaccaggacggaatttaatttccttaacctggataactttttgctttttcttctgttccttagaagacttgctcttttcatagaggaatttgccgtaatccattatacgacaaaccggcggctcggcgttagggctgatctcgactaagtctactccggcttcttctgctttctccagagcttctctcagactcacaataccaagctgctcgccttccagacctgttaagcgaacttcctgggcgcgaatttcgccattgatacggttagggcgcgccgtttgaactcgttttccgcctttaataccttattcctccaattgtttaagactgcggctgcgaatctcttgttgcagcttctcgatcacttcatttacgtccatgcttcccaggtctttaccacggcgggtgcgaacggcaactttgcctgattccacctctttatcaccacagaccagcatatacgggacgcgacgcaaagtgtgctcgcggattttaaagccaatcttctcatttctcaagtctgctttaacacgaatgcccgcatttgatagtttttgcgtcaattcgttaacgtattcagactgtgaatcggtaatattcatgataacaacctgaaccggcgcaagccaggtcgggaagaaaccagcgaattcttcggtcaggataccgatgaaacgttccatcgaccccagaattgcgcggtgaatcattaccggtaccttacgctcgttgtcttcgcccacataggaggcgctcagacgagacggcaaggagaagtccagctgtactgtaccgcactgccatgcacgatcgaggcagtcatacagggtaaattcaattttcggaccgtagaaagcgccttcacccagttgatattcaaacgggatgttgttttcttccagcgcaaccgccaggtccgcctcagcacgatcccacatttcgtcgctgccaatacgtttttcaggacgagtggagagtttgacgacgatcttctcgaagccaaaagtgctgtacatatcatagactaaacggatacatccgttaacttcatcgcgaatttgttcttcagtacagaagatatgcgcgtcatcctgggtaaaaccacgcacgcgcatcaggccatgcagcgaacctgacggctcgttacggtggcagctaccaaactcggccatacgcagcggcagatcgcgataagacttcagcccctggttgaaaatttgtacgtgccccgggcagttcatcggcttaatgcagtattcacggttctcagaagacgtggtgaacattgcatctttgtagttgtcccagtgaccggttttttcccacaggacacggtccatcatgaacggacctttaacttcctgatactggtactctttcagtttagaacgaacaaacacttccagttcacggaagatggtccagccgtcgttgtgccagaataccatacccggcgcttcttcctgcatatggtacaggtcgagctgtttaccgattttacggtggtcgcgtttcgcggcttcttccaggcgttgcaggtaagcgttaagcgcttttttgtctgcccacgccgtaccgtaaatacgttgcaacattttgttattgctgtcgccacgccagtaagcccctgccgttttcattagtttgaaatgatggcagaaacgcatgttcggtacgtgcggaccgcggcacatatcgacatattcttcatggaagtacagacctggcttgtcatcatgggcgatgttttcgtcaagaatggagactttgtagctctccccacggttggcgaaagtttcacgcgcttcatgccagctgactttcttcttaatgacgtcgtagtttttctcagcaagctcatgcatccgcttctcgagtgcttcgacatcttcctgggttaacgtgcggtcaagatcaacgtcgtaataaaaaccgttgtcaataaccgggccgattgccattttggtatgcggccaaagttgtttaatcgcgtgccctaacaggtgcgcacaggagtgacgaatgatctccagaccttcttcgtctttggcagtaatgatcgacagttgtgcgtcgttttcaatcagatcgcaagcatcaaccagttcgccattaacgcgccctgcgatacaggctttcgccagacctggaccaatgtccagcgcaacatccatggggcttacagcgtggtcgtaatggcgttggctgccatcaggaagagttataacaggcattttatatccttatttgcagtggtgacccacacgaaagatcacatacaaagaaaaatttgtttattaacagttcattgcgaaaccatctagccaacaaatgctaaattggtccgcaatcaggtacacaaatgaaagacattaacctctcaccttccacccggttgaacgatgttaacactaaaaaaagggagattgtacctttccgtttcacattgattcgattcgcaattcgtttgtagtgagtacaccagcaaaacgcttaaagaaccactgataacatcacagagtgtctgaaaggtttactacgagcggatttacagcagcataaactgaatccagcaaagttcgttgcgtgatttggcggtagtatttaaacgatcatgagattaatgacgaagtagtcatatcgcaatgataaaagtgacataattcttatagcaatttttcgtgcgcatttcgttctggcgataataatcaatcatcatcctcaaaatctccagacatatataaggcgaatagattatgagtaaaaacgatatcattatcggaactcattataagtctcctcttagaatgcacatcgatagcgacatactaacgccttcatcagagcctattaatcaatttgcgcgccagctcatcaccctacttgatacctctgatttaagttcgatgctgtcatactgtgttactcaggaatttaccgcaagctgtcgaaaaaatatcacacaattgttataccactgccctttttatcattagctttaccacttcacccatccatgcagaaaatacacttattacattacactataaaaaagaaatcatttccttatttctggaaaccacgcctattaaagctaaccatttgcgaagcatactggattatattgaacaggaacagttaactgccgaaaaacgtaaccattgcatgaaactgtccaaaaaaaattcatagagaaaaaaccatacagccaacagtaaatctcaatgatagtgcatttttttgcaatctccttctgacactattttttgtcgccatctgtcattaaaatacgcccttgattcattgagaaatggaaaaggcaaagtcaacctgattaaacattactcctccattgaatccatacagcagcatgttcccttagtccgggacgcggaattcagagcattacttcgccatcctcttgcaaggagtcgcgttatcgcgagtcaggattttggctttgctttagatattttcttctgtcgaatgatggcaaacaatgtcagtcatatgtccgcgattttatatatagacaatcatactttgtcagtaagtaaagatgtcgtgttatcttatatatcaacgttgggtacttttgaaaaaaatattcttttagccaacgtcagttatttacactgttggccgctaaaaatcatgacaacatgtcagctgttcatatagccattcatcataatcatcataaaactgtagaaacatattatgctgctataaatgtaatcagccaaagcctgagttttagtgctgatgaactaaagacgtatttataacccgctatttatgatatttgtatatcgatacataatttttttcataaaatgcagaaacagtgaccaggtgtacaacgccacccgacgactgtaataacaaaaaatcccttgatgcctgtcccttttgttacactccgttatcacgcacaagagatatgcaggacactggtatgccgactaaacgctttgataaaaaacactggaagatggtggtggtgctactggcaatctgtggcgctatgttgttgctacgttgggcagcaatgatttggggctgagcagtgacaaacgaaaacagccagaccgcataacacggtccggcagataattttacatgctgtagcccagcgataaggttgtccgacgatcggtatgttccggtgcagactctggaggttcagagttccatgtgacgttgtaagccaccttcagtccaaaatgttcattaatagcaacatttaatgcgctttcggagttcagcgttgtgtcttccgcgccgaagaccgaaacaccctgcgtaaatttagcgttgtcagtcaactgccatgcataagccccggaggcatagcccagcggctgggtttcactggcattgtcggtatatttgtcgtaacgcacacctgggccgaattcaaagcggaaactgtgtactgggccattcaaaaactggcgaccataacccgcggtcaacacatcgcgctctcgatagccgttataacggtctgtcagccagcttgcctgcccaaataaatagtcataatcagttaaattaaaacggctacgcccgcccgccgcatatttttctgaagaacgctcatcattagaagaagtattactggcgttcccccacagcgaccaggcagtggtttgtccataccaggtcatggtggtgtcagccgtaagtgaggagcttttcgtattgcctgattgtgcaagatatcctgcgttcagattaccttcgaaaggttttttagcgctggcaggatcgtccatgacagtaaaaacggaatcatcggcagctgcattcagtgacgcaaacatgccccccgccaacataacgatggcaggaactgtcttcaaaagcttcatttatcaagagtccgtacaacaaaaaaagagaccatcgcggtcccggaaactttcttaaggataaagattagcgtccctggaaaggtaacgaattataaaaaggcgcgaataacttagcaatgtattcttatttcattttttgaataagcatgtggcgaaaacagatttttatttatatatatttatctgcaaaattttaagtaaagctccaataaatcatattgttaatttcttcactttccgctgattcggtgccagactgaaatcagcctataggaggaaatgatggtacgtatctatacgttgacacttgcgccctcactcgatagcgcaacaattaccccgcaaatttatcccgaaggaaaactgcgctgtaccgcaccggtattcgaacccggaggcggcggcatcaacgtcgcccgcgccattgcccatcttggaggcagtgccacagcgatcttcccggcgggtggtgcgaccggcgaacatctggtttcactgttggcagatgaaaatgtcaccgtcgctactgtagaagccaaagactggacccggcagaatttacacgtacatgtggaagcaagcggtgagcagtatcgttttgttatgccaggcgcggcattaaatgaagatgagtttcgccagctcgaagagcaagttctggaaattgaatccggggccatcctggtcataagcggaagcctgccgccaggtgtgaagctggaaaaattaacccaactgatttccgctgcgcaaaaacaagggatccgctgcatcgtcgacagttctggcgaagcgttaagtgcagcactggcgattggtaacatcgagttggttaagcctaaccaaaaagaactcagtgcgctggtaaatcgcgaactcacccagccagatgatgtccgcaaagccgcgcaggaaattgttaatagcggcaaggccaaacgggttgtcgtttccctgggtccacaaggggcgttgggcgttgatagtgaaaactgcattcaggttgtgccaccaccggtgaaaagccagagcaccgttggcgctggtgacagcatggtcggcgcgatgacactgaaactggcagaaaatgcctctcttgaagagatggtccgttttggcgtagctgcggggagtgcagccacactcaatcagggaacacgcctgtgctcccatgacgatacacaaaaaatttacgcttacctttcccgctaactgaaacattcccccagcattgggggaatcaccaccaacctgtcggcaacgcgtttctccgactatgctcaaaagtcatgtgataacaaaggggtgaactatggccagtggcgatcttgtccgttatgtaataaccgtcatgttgcatgaggatacattgactgaaattaacgagttgaataattacctgactcgcgacggttttttgctcaccatgacggatgatgatggcaatatccatgagctggggactaacacttttggacttatcagtacccaaagtgaagaagaaattagagaactagtttcggggcttacccaaagtgcaaccggcaaagatcctgaaatcaccatcacgacctgggaggaatggaatagcaacagaaaataaatggtttttgggcaataatcagtctgtggtgtgcgttagctcgtgtttttacaccacattcttgcgctaaccttatgatctggcagacaacatgggagagacatcatgtggcaggcaatcagtcgtcttttgagcgagcagttaggtgaaggcgaaatcgaactgcgtaatgaactgcctggcggagaagtccatgccgcatggcatttgcgctatgcaggacgtgactttttagtcaaatatgatgaaagggaactgcttcccggttttaccgccgaagccgaccaactggagttactgtcgcgtagtaaaaccgtcaccgtgcctaaggtttgggcagttggcgctgaccgtgactacagttttctggtgatggattatctcccacctcgcccgctggatgcgcatagcgcatttattcttggtcagcaaattgcgcgtttacatcaatggagcgaccaaccacaatttggcctcgatttcgataacgcgctctccacaactccacagcccaacacctggcaacgtcgctggtcaactttttttgctgaacaacggattggctggcagctggaactggcggcagaaaaagggatcgctttcggcaatatcgatgccatcgtcgagcatattcagcagcgtctcgcctcgcatcaaccgcagccttctctgttgcacggcgatttatggtccggcaactgtgcgctgggtccggatggcccgtacattttcgacccagcctgttactggggtgaccgagagtgcgacctggcgatgttaccgctgcatactgaacagccgccacaaatctatgacggctatcagtcagtatccccgctacctgccgatttccttgaacgtcaaccggtttaccaactctacacgctgttaaatcgtgcaaggttatttggcggtcagcatttggttattgctcagcagtcactggatagattattagcagcatgatatgggttgaggataatggccgctccgtgcggccttttgattaaataaacccaagcagagaaaagaacacataacctgcagcaatacaaataagcggcaggatatacagcgagaaaaactgcaggaaaatagtatggtgcggaacaacaatacgtgactcaatttgttcacgcgttagcccctcttcccctttggctttttccagaatgagttgatcttcaacaccttcccgcaagaagcgcgcctggcgactcatccgggctccggaatcctgcaacgccagtccgacaaaaatcaggatgaaaatcacccagaacataacgttcacgccaccattaaaattgggcgtcggagagttgtaccagaacacattcaaaaaaggcgtattcgcctgcatcatatcgatcatgacatgagtaaagtcgagcatgaccgcattaatgccttcctggttttcctgccgggtattcataaatttcagcaaagaaatcaatgtagagatcaatgcaggtataaaaatcacccaacccaaaatccttttcaaaacagcaatgcgtccagcttgttgatacgtcatgagttctccttgattaagacgcgtcgtttcacttagtttacctgtagatatctgttttcgcccattctttaaaggcgatatgataggcgcttaatcataagcacggcttaataccttacatataatgctctaaaggagaggttgtaatgtcaaccccgcgtcagattcttgctgcaatttttgatatggatggattacttatcgactcagaacctttatgggatcgagctgaactggatgtgatggcaagcctgggggtggatatctcccgtcgtaacgagctgccggacaccttaggtttacgcatcgatatggtggtcgatctttggtacgcccggcaaccctggaatggaccaagccgtcaggaagtagtagaacgggttattgctcgtgccatttcactggttgaagagacacgcccattattgccaggcgtgcgtgaagccgttgcgttatgcaaagaacaaggtttattggtgggactggcctccgcgtcaccactacatatgctggaaaaagtgttgaccatgtttgacttacgcgacagtttcgatgccctcgcctcggctgaaaaattgccttacagcaagccgcatccgcaagtatatctcgactgcgcagcaaaactgggtgttgacccactgacctgcgtagcgctggaagattcagtaaatggcatgatagcctctaaagcagcccgcatgcgttccatcgtcgttcctgcgccagaagcgcaaaatgatccacgttttgtattagcaaacgtcaaactctcatcgctgacagaactcaccgcaaaagaccttctcggttaataaccaggggcagttatcacgctgcccctggttatttatctgaatttgcattcaactggcggattaatcgtcaatttaagagaaagagttacaccgtcaccacttccgtgcactgtataaaaatcctatactgtacgtatcgacagtttagtgagttttatcatgacggcggaaggtcaccttctcttttctattgcttgtgcggtatttgccaaaaatgccgagctgacgcccgtgctggcacagggtgactggtggcatattgtcccttccgcaatcctgacgtgtttgttaccggacatcgatcacccaaagtcgtttcttgggcagcgattaaagtggatatcaaaaccgatcgcccgcgcttttgggcatcgtggttttacccacagtctgctggcggtatttgcgctgctggcaaccttttaccttaaggttcctgaaagctggttcattccggctgatgcattgcagggcatggtgctgggttatttgagccacatacttgccgatatgctgacacccgctggtgttcccctgctctggccatgccgctggcgtttccgcttgcctatcctggttccccaaaagggcaaccaactggaacgttttatctgcatggcattatttgtctggtcggtatggatgccccattcattacccgaaaacagcgctgttcgttggtcatcgcaaatgatcaataccttgcagatccagtttcatcgacttattaagcatcaggttgaatactaaaaaggcaaaaatcacctttctggaataagcaattccatttgaatataagagccagctcacagttctgttaatcttgcgccaacactatgactgctacgcagtgatagaaataataagatcaggagaacggggatgaactttccattaattgcgaacatcgtggtgttcgttgtaccgctgtttgcgctggctcagacccgccataaacagtggagtctggcgaaaaaagtgctggtgggtcttgtgatgggtgtggtttttggccttgccctgcataccatttatggttctgacagccaggtacttaaagattctgtacagtggtttaacattgttggtaacggctatgttcaactgctgcaaatgatcgttatgccgctagtcttcgcctctattctgagcgcggttgcccgtctgcataacgcatctcagttaggcaaaatcagttttctgaccatcggtacgcttttgtttaccacgctgattgctgcgctggtcggtgtgctggtcaccaacctgtttggtttgacggctgaaggtctggttcagggtggtgcagaaactgcacgtctgaacgccatcgaaagtaactatgttggtaaagtctctgacctgagcgttccgcagctggtcttgtcctttatcccgaaaaacccgtttgccgatctgaccggagccaatccgacgtcaattatcagcgtggtaatttttgccgcattcctcggcgtagctgcgctgaaactgctgaaggatgatgcgccgaaaggtgaacgcgtcttaaccgctatcgataccctgcaaagctgggtgatgaaactggttcgcctggtcatgcagttgaccccttacggtgttctggcgctgatgaccaaagtggttgcaggttctaacctgcaagacatcatcaaactgggaagtttcgttgttgcgtcctacctcggtctgctgattatgtttgcagtgcatggccttctgctgggcattaatggcgtgagcccgctgaagtacttccgtaaggtatggccagtactgacgtttgcctttaccagccgttccagtgctgcgtctatcccactgaatgtggaagcacaaacgcgtcgtctgggtgttcctgaatccatcgccagtttcgccgcctctttcggtgcgaccattggtcagaacggctgcgccggtttgtatccggcaatgctggcggtgatggttgcgcctacggtgggcattaacccgctggacccgatgtggattgcgacgctggtcggtattgttaccgttagttccgcaggcgttgccggtgtcggtggtggtgcaactttcgccgcactgattgtgctgcctgcgatgggcctgcctgtaacgctggtggcattgttaatctccgttgaaccgcttatcgacatggggcgtacggcgctaaacgttagtggctcgatgaccgctggcacgctgaccagccagtggctgaagcaaaccgataaagccattctggatagcgaagacgacgccgaactggcacaccgttaattctgatttgttacgttaaacgcctgtcatcccgacaggtgtttttttattcttcgacctcattttcctgacgaatctgatttgcccaacgctgggcggattcaggcacagtaaacgccggtgagcgcagaaatgactcccccatcagtacaaacgcaacatatttgccacgcagcatccagacatcacgaaacgaatccatctttatcgcatgttctggcggcgcgggttccgtgcgtgggacatagctaataatctggcggttttgctgacggagcggtttcttcattactggcttcactaaacgcatattaaaaatcagaaaaactgtagtttagccgatttagcccctgtacgtcccgctttgcgtgtatttcataacaccgtttccagaatagtttccgaagcgggatctggctggtggtctatagttagagggttttttgaccaaaacagcggccctttcagtaataatttaaggagacgagttcaatgtcgcaacataacgaaaagaacccacatcagcaccagtcaccactacacgattccagcgaagcgaaaccggggatggactcactggcacctgaagacggatctcatcgtccagcggctgaaccaacaccgcctggtgcacaacctaccgccccagggagcctgaaagcccctgatacgcgtaacgaaaaacttaattctctggaagacgtacgcaaaggcagtgaaaattatgcgctgaccactaatcagggcgtgcgcatcgccgacgatcaaaactcactgcgtgccggtagccgtggtccaactctgctggaagattttattctgcgcgagaaaatcactcactttgaccatgagcgcatcccggaacgtattgttcatgcacgcggatcagcagctcacggttatttccagccatataaaagcttaagcgatatcaccaaagcggatttcctctcagatacgaacaaaatcaccccagtatttgttaggttctctaccgttcagggcggcgctggctctgccgataccgtacgtgatatccgtggctttgccaccaagttctatactgaagagggtatttttgacctcgttggcaataacacgccaatcttctttatccaggatgcgcataaattccccgattttgttcatgcggtaaaaccagaaccgcactgggcaattccacaagggcaaagcgcccacgatactttctgggattatgtttctctgcaacctgaaactctgcacaacgtgatgtgggcaatgtcggatcgcggtatcccgcgcagttaccgcactatggaaggcttcggtattcataccttccgcctgattaatgccgaagggaaggcaacgttcgtacgtttccactggaaaccactggcaggtaaagcctcactcgtttgggatgaagcacaaaaactaaccggacgtgacccggacttccaccgccgcgagttgtgggaagcgattgaagcaggcgattttcctgaatacgaactgggcttccagttgattcctgaagaagacgaattcaagttcgacttcgatcttctcgatccaaccaaacttatcccggaagaattggtgcctgttcagcgtgtcggcaaaatggtgctcaatcgtaatccggataacttctttgctgaaaacgaacaggtggctttccatccagggcatattgtccccggtctggatttcaccaacgacccgttattgcaggggcgtttgttctcttataccgatacacaaatcagtcgtcttggtgggccgaatttccatgaaattccgattaaccgcccgacctgcccttaccataatttccagcgtgacggcatgcatcgtatggggatcgacactaacccggcgaattacgaaccgaactcgatcaacgataactggccgcgcgaaacaccgccggggccgaaacgcggcggttttgaatcataccaggaacgcgtggaaggaaataaagttcgcgagcgcagtccatcgtttggcgaatattattcccatccgcgtctgttctggctaagtcagacgccattcgagcagcgccatattgtcgatggtttcagttttgagttaagcaaagtagttcgtccgtatattcgtgagcgcgttgttgaccagctggcgcatattgatctcactctggcccaggcggtggcgaaaaatctcggtatcgaactgactgatgaccagctgaatatcaccccacctccggacgtcaacggtctgaaaaaggatccatccttaagtctgtactccattcctgacggtgatgtgaaaggtcgcgtggtagcaattttgcttaatgatgaagtgagatcggcagaccttctggccattctcaaggcgctgaaggccaaaggcgttcatgccaaactgctctactcccgaatgggggaagtgactgcggatgacggtacggtgttgcctatagctgctacctttgccggtgcgccttcgctgacggtcgatgcagtcattgtcccttgcggcaatattgcggatatcgctgacaacggcgatgccaactactatctgatggaagcctacaaacaccttaaaccgattgcgctggcaggagacgcgcgcaagtttaaagcaacaatcaaggtcgctgaccagggtgaagaagggattgcggaagctgacagcgccgatggtagttttatggatgaactgttaacgctgatgacagcacaccgcgtgtggtcacgcattcctaagattgacaaaatcccggcgtaaatatggataaggtcacgcccctggggagtgaccttaccaccttacttacacatcatgataactacccaacagataaccacgctcagcaatcgcatatttcaacgacgctgaagtcagcacatccagttccgttaaccgagggaagcaataagcactctggcgaatcgtattatcgacaaacgccggatggcacataacttccaacgagcgttccccgcgatggctggaatcatcaagcacttgcaggaacagtgtctcgctaatctcttcaccataaaacgcgctactgaatccctgcgaactgcgcagattagccggtaaatcaccatcgttagataacggctgacggtcgatgcgcaacgcaatcccctcttcagccgcaaactttgccacaatcgggaaaatctgcgggaacatatgcacatgatgatggctatcaagatgcgtaggtttgcgtccaaatagctcaatgaaacgcaaatactgactggcgagctcctgagtaatttcttccagcggtaaagcaccttcttctgccaactgccagatccattttcccagcacaccatcgcgggttaaccccggcatagctgtcagaggcttgcccatagtaaggacaaagtgcatccctatggccagactcggttcatcacggctcaactgcaccgcatggtcaatagcctgcccattcaccagcgccgtcgtcgacgtgacaatcccattgcgacaggcctcgataatgccgtagttctgacctttgcttaagccaaaatcatcggcattaacaatcagtaagcgttccataatcagcctcggttaatgtgcttttttaagctctgcgatgcagtcggcaaaatttggcagccatttctcgtgcgccagaatcatctcgcgtgccagcagctcagcatcgcgatcggaatgcaccaacggactaaggtttagcgccagtaagacatcgttaaattctccactaagtgcggcgttgctggcagcaatctcgaagcctttgatggtgtgaatcagccccatcactttatcatcgaaatgcgtaatgcgcggatgtggcgtcgcgccatcgcgccccagcgtacaggtcatttctaccgcccagtctgccggaatattatcaatatgcccatgatgcgggatattaacgtaatgttctgcttgcttgtcgttatagatagcgttgatcacttcgcacgcagcatcagaataataagccccaccgcgctgttccagttctttcggcttaacgttcaactccgggtttttatatagctcaaaaagttgtttctcgactttctgtacgacctgcgctcgtgcgccgcctttgtagtattcgcccatttcaatagccagcatctctttttgcttgaagtaataaagcaaataagaacacggcaacagattcagagaacgaattaagccttcgctaaatggcagatcgaaaatatttttaacgccagatgcttttaactgcccggatgccacaccatcaagcaattcggcaaagcgtgatttgccatttaccagcacatccttaatgaacaccatatggttgaggccgaacagatcgatagataaatcatcgctgtctttcagcatcagaacatcgcgaataaacatcttcatgccgatcggaatattacacacgccgataaagcgtttaaatccggtatgacgataaacggcttcagtgaccattcccgccgggttagtgaagttaatcacccatgcattcggacatagttcttcgacatcttttacgatgtcaaaaatcaccggaatggtacgcagacctttaaacagaccgcccgcgccgttagtttcctgaccaagataaccatgacttaatggaatacgttcatccaattcgcgcgccggtaattggccaacgcgcagttgggtagtaacgaaatcagcatctttcaatgcttcgcggcgatccagcgttttataaagcttcatcgggacgccagcgttatcaatcatccgttggcagagatcaaaaataatatccagtttcgctttaccaccttcgacatccaccagccataattcgctgaccggcaattcgtgataacgcttaataaatccttccagtaactccggggtatagctgctcccgccaccaatagtgacgacttttaatttctggctcataatttctcccttcagtacagaatactgatatctggcatatctgccccccggacataaataatccagcaacaggacagatatgtgaattgtcaggtataacgacttactgattaaattcagtcaatttcttacgatagctcttaggcgtaaaggatgttaatttcttaaacgttttaataaacaagctcgggctactataaccggcctcaaacgcaatatccgtcactgaatagttggtcatttccagttgttttttggcaaaattaatacggatttcattaataatctgcattggcgttttaccatagtatcgttgagtcgctcgcgtcaaatattcctgtgatttggctgacaacgtcaccatattctccagcgccgattcactaaactgctctttatcatgcatcttttctaccgtacttttcagccactgcggtatatcatcaatcacctgttcttcgcggtaatgacgtaaacggttaatgacataaaaagtaaccatctcaacaaactcttccagccctgtttcgcggaaattcaatgaagaaatcactgtttccacataggtgagaaaagcgttattggtccggtatacctgcgaagctacaaagcaataaggcaacaacggcaggtaatgctgctcaaaaaagcgtttactgatcccaacgttcaatatacgcgtggcaccaaattcataaaaactttgatggtgcgaacctaacggaataaaaacaaaatcgccccgttccagtaacacgcgcttaccgttaatctcctggaaataacgcccggttaataccagagtaaattcataatagtcgtgctgatgcagtccgctgatactctcagttttattgtagataaacacatggaagtttttgccattaaacaactgctgttctcgggcagtggcaatttccggcgcgttaatcactggctgcatcatcgactccttatgccttcagtttttcatgaagctcaattaattcagtaatcagttcacgcgcaagcatggacgtcattaaatgatcctgagcgtggactagcaccagactcactttcatcttaccttcgccagcatcgccttcaatcagtttcgtctgtaccagatgcgcttcattcaatgccatccgtgactgatccatcatggtttttgctgcggcaaaatcgccctgcttcgcctgtttcagtgccgcatacgctaggctacgcgcttgtccggagttgatgataagccccatcaccacttcttccagctcttcagcttccgtttgcgtatcgggaatattatcgagatccatcatacatcgttcctctctattcttaccggcacgattacccgtaccggcatcaattaaaatttcagggcgttggcgatatcttcttcgctctcttctttatcaatcgcgttttgtgctttgttagcgaccacaacaaagggcagataaattaacgttgcgataccaaggttgaagagtgcgaccagcaatgcggcgacgctaccgttggtgttaaagaaggctcccagaccggttggcatggtccacggtgcaatattggtcaccggtggaataatgcccatgtagtacgctgccagggtgattgccgccagaatcggttgtaccagtacaaacgggataaacatcaccgggttcatgataattggcagaccaaacagaatcggttcgttaatctggaagatgccggacggcagcgccagttttgccacctgacgataatcagcacggcgagaagcgataaagatagccaggatcaggcctaaagtcgcaccactgccaccaaggaaaataaaggagtccagcatcggcttggcccagatatggaaggtcttaccggctgccagcgccgcttcgacggaaccatattgctgataggtcgcgatattttccagcgcccacggcgtcataatgccgttgtccagtgcggtcagcgccagcgcgccatgaataccgaagaaccagagcagtggaacaaagatcacataggcccagcctaccacgctacccaacgatgccagtggggttgagatggtatccataatgatctgatggaagttggtgccccaggtattcaacgcccaggcaataatccccatcacggaaagaataataaaaccgggaattaatgctgagaaagagcgcgaaaccgatgtcggaacgctatcaggtaacttaatgacccagttacgatgaacaataaaggtaaacatttctgccaccaccaggccaataataatcccggagatgatattcgccccacctaaccagtttgcgccaaccgcataggcctcaccgacactatatggggtgacggtcataaatgctgcaacggataacaacccggccgccagcgcatcgactttacgctcttctgccagcgccatgccaataaagaacggggccattaaagacattatccctaatgttccgttatatacgttgccgccaatacctttcagaccattaagtgtttcaatggttgaggcatccaggcgaatacctaaggaataaaaaaacgacccctccccaaagcttagaaaaacgttgttaattaatacaaacatggcccccgcaagggttaacggcattaagcgaataaagccatttttgattgcattaacgtgtggctgctttcctattttaactgcaaaagggaggagtaccttttcaagcgatgcaataacattactcatagaaaaataccctttaaaaccgcaatttaaatattgcggtattgatttatgaaataactctttgacgggaaaatttaaaataaattaatttgctgcggcttttttaatcgctgcaaccgcagccttaagcacgcctaaaccatcgactttgccataaagcagcgagtcaattacttcaaccggtttgttgggtaacaaacgctggatttcgggcaacatataagcaatctgcggccctaataacacgacatcggcattctgacctttttcaccagccagtgtttccggaaatgcttcaataatgaccggaacttcatatttttctgcctgtgcgcgcatttttgataccagtaaagaggtagacatgcccgcagaacaaaacagataaatgtgtttcttttccataaaactgccctcatcgacgattatctgtcagccagacactccgcaagccttaacctgcttccatgctctgggtaacttgcgaaaccaacatgactttttttgtggctgaaaggagtatacggtataggcctgagcaatagcatttctttgaccttataaattgtctctccttgacctgtggttatgaccctcttcacatttcgggcaaataattcgcgaagataattaagaacacaggccaaaaaaaaccggcgcaatggccggtttccgttgttactcaagctttcaggcgaagtgattacttcgtagcctgtggatcagtgtcgtattcagcacaggtctgataaccggagttgatgacatgtccggtatcatctaacgcgacaaagtaggtttctgctttaccatcacgttgacccaggatgtaggtctggcaagtaccacgagcatggatcatgctcacttcagacgaaggtttacccgcaatttgtgcaacctgcgcccggctcatgccttttttgacgtctttcaccacaggctgtacaaactggtctttggtacgatcataagccgtacaacccgccagcatggttaataccgccgctgcactcagaattcctgccatattcttgttcatattccgtcctcttgtttatcagcgtgttagataagcctggaatacattgggcgctttttcaagcccgtgaacgaaacggctccgctttcagaggattcctgtatgacgttttaaccaccattcagcccgctgtcgcttgtcgtttcagtagcaacgggttagctttaaggaagttttgtcttttctgtctggaggggttcaatgacattgcaacaacaaataataaaggcgctgggcgcaaaaccgcagattaatgctgaagaggaaattcgtcgtagtgtcgattttctgaaaagctacctgcaaacttatccgttcattaaatcactggtgctagggatcagcggcggtcaggactccacgcttgccggtaagctgtgccagatggcgattaatgagctgcgccaggagaccggcaacgaatcactgcaatttattgccgtacgcctgccctatggtgttcaggccgacgaacaagattgccaggatgccattgcctttattcaaccggatcgcgtattaaccgttaatatcaagggcgcggtattggccagcgaacaggcgctgcgcgaagcgggtattgaattaagtgattttgtccgtggcaatgaaaaagcgcgtgagcggatgaaagcacaatatagcattgcgggtatgaccagcggtgtcgtggtgggcaccgatcatgctgcagaagctattaccggattcttcactaaatatggtgacggcggtacggacattaatccgctgtatcgtctcaacaaacgtcagggtaaacagttactggcggcattaggttgcccggaacacctttataagaaagcgccaacggccgatcttgaagatgatcgcccttctctgccggatgaagtggcactcggcgtgacctatgacaatatcgacgactatctggaagggaaaaacgtacctgaacaggtcgccagaacaatagagaactggtatctgaaaaccgaacataaacgccgtccgccaattaccgttttcgatgatttctggaaaaagtaataatttgcacatattggtttgtacgaaaaagagtactttgttcacgccggatgcggcgtgaacgccttactcgacctacaaaactatgcaaattcaatacattgcaggagtcgaataggcctgacaggcgtagcacgtcaaacggtgtaacctttgtcatcgacccgcctcttttttaatcgctctccgcctgttacactggatagataaccagcattcggagtcaacagtggtacggcgtttaacttctccgcggctcgaatttgaagctgcggcaatttatgaatatcccgaacatttacgttcattccttaatgacttacccacccgaccaggggtgtatctgtttcatggcgaaagtgacaccatgccgctctatatcggcaaaagcattaacatccgcagccgcgtcctttctcatttacgtaccccggatgaagccgccatgctacggcaatcccgacgcatcagctggatatgtaccgccggtgaaatcggcgctctgctccttgaagcgcgattaatcaaagaacaacagccactgtttaataaacgcttgcggcgcaatcgccagctctgtgccctgcaattaaatgaaaagcgcgtcgatgtggtgtatgccaaagaggtggatttttcacgagcccccaacctgtttggcctgtttgccaataggcgcgcagctttgcaagcattgcagaccatcgctgatgaacaaaaactttgttatggcctgttgggactggagccgttaagtcgcggtcgtgcatgttttcgttcagcgctaaaacgttgcgccggagcatgctgcggtaaagagagccatgacgatcatgcgctacgtttgcgccagtctctggaacgtttacgagtcgtttgttggccgtggaaaggtgcggtagcgctgaaagaacagcacccggaaatgactcaatatcatattattcaaaactggctgtggctgggggcggttaattcgctgaaagaagcgacaacgttaattcgggcacccgccgggtttgatcacgacggttataaaattctttgtaagccgctgctttccggtaactatgaaattactgaacttgatccggtgaatgaccagcaagccagttgatttcactgaacaacagtttaccttgcggttgcaaaagccgcagggtgtgcctgccatcgaaccagcacgcgccctggtcggtagtgagcagtttgtcgcccaattgccacgccccgtttattacaaacaccaccccgccgcgtgaaccaaaggtagtaaacgtacgttcggcaattctgactttcgccttacagacatccaggcgtgtcatgatgttgaaatccatcgacatctgccctgccgtcagtttcgcttttaccaccaggtccgctgcaaaggaaaaaggttgtaacggttttaaggtatggttaaagcggtctgcgctttcaaggaacatctcgccgccttccagcaacgtcactatcctttccataccgggaaacaaagaaaactccccattcgccgcgatggatgtaatgctggcacgccagtaaaaatcacgttttgccggtgggaaagtgcaaatttcgcgcgtttcaccggcagcgtttcgccacagattcaccgacattttacgcatatcaaagtattccatacccgctcccggcccgttcttttcattgttatcgttcagataaccgtggatggttatcggcaactcgggtgatttacgttagtggcgatcaggctttttttgcatctgtttgagaagagaaaagaaaaccgccgatcctgtccaccgcattactgcaaggtagtggacaagaccggcggtcttacgttttttggctgaaagattattcagcagttgcaggcattttaccttttgccgctggacgttctgtcagacgcttctcaaaattagcattaaattgctttttctgttccggcgtcaggatgttgtaaatcttgttctgggtttccatgtgcgccagcatgttagctttgcgctgttcttccatttttgcgatctgcgcttcagcttttgctttatcgaaggtatcgctggcaatgatgtcatgcattgcgcggcgttcttccagcggcggacgtttcatctggtcacgctggcctttcatgatttcgcggatctgctgtttctgcgcgtcggtcaggttcaggtctttgaacatcatgtcctcatgcggaccgaacttgcctttatggtgcatcatcggcttcgcgtcagccggtgctgcggtagtggtgtctgcggcatgggccaggttagccgcgccaagagccagggtagaggcaacaaacagtgcagttaatttacgcatattctatatccttcctttcagttatttattacggctttcttaagtagcgtgccgtgttgacgagattaactttactgactttagcgtcaattaatctgagcaacggtaaaacaatgaaagtgtaaaaaacacttttgcgccaattatggagaaaaaaagaaaatttgatggagagtgatgagagaatattacaacacgatgattttgcagagattatgaagaactataccggatgactggtgataaataaagcaaataaccaggattaatctgtattaatttataagaaagcaacttaatacccgcagaatgatttctgcgggtaagtattagcttattttttcgagcattaatcccgcacgtaatcccaacgctaccaacggattagggaataacacatactctacatcatgggttacggtaaaacgttcctccccgtcctgcgccagcaatgttcctttctcaaacggcataaaattcagcgtgtcatttgccatatgcatttcgaaggacggcgagtggcgagtaatttgcgaaaccacccgataacggagcggcggtgttctcacgataccgacactctcaccagatagcagcgcagcaattgcgctggcagttactgcaaactggcgaagatcgttttgcccaaagggcaacgctttgccaagttccagcgtacaggccagcgcgccaaaatgtctggcgctgaaatgggtaaacgtaccaccaggctcctgatggaacaccagcgcctccagccccgccgcacccagccacgtcagaaatttctcgtcccagggaatgtcgcgttgcggtaatacaccgaactgcggatgcaaggagccacgaattgcggtatgtagatcaaggtgccagcgcacagattctttgccctggtcataaaaatcttccaggcactgctccagttcgcgcgcccgacaggtttccccgctttcagcaaacagttgccaacgaccgccaaacattcgattcatatcgctatggcaataacgtttcccttgcttcagcgcaggaggattcccgaggatcaccagtaaccgccaacgtaacgggatctcaccgtgagatatcgcgccaagcaacgcgtccagcatttccacaggtgccgtctcattaccgtggatccccgctgaaatcaccagcacgccttgcggtggcgttaatggcgtcagttccagcacaccatcgcccagccagcgccagcgaacgccgttgatttctcgctcggtgatgaccggttttttacccgttaaggttagagcaagaaaattatccattgccccctccctcgcgctggaatggataaaccgaaccaagatccaataattgagtcagtgtatccagcgcttcccttccttcgcgcagcaattgtggatcggcaagatccgccgcagtaagacgatcgcggtagtaacgatccacccagtcattgagcgcattaaacagcgtatcgttcatcatcactgccggattcaccgcccggcgttcttcttctgtcaacaccacgcgcaaccgcaggcacgccgggccaccgccattcgccatgctttcacgtaaatcaaagacttttagttcgctaatcgggttgtcagcagcaagcaattcgttgagataacgccatactccggcgtgttcccgacactcctgcggcagcaccaacaccatggaaccatcatcgcggctcagcagttggctgttaaacagatacgtagataccgcatccgacacggaaacctgagtcgccggaacttctatcgccataaaaccattgacccgcgcacgcaggtttgccagtaactgtgactggcgagcgaacgcctgttgatggcaaaacagcacctggcggttactcacggcaatcacatcattatgaaaaacgccctggtcgataacgtcggggttttgctgggcgaaaatcacctgctgtggattcacctgattcagccttgccaccgcctcgctggcttcacgggtctgccgcgccggataacgggaaggccgggtatcattgccctcttctcgcccgtagacaaaaagttgcatacccggttcaccgtaatgaccgccgagacgattgtggtttgccgccccctcatcaccgagcaaggctacctgcggcaacgccgaatggacgctaaatttctcttcgtcgttaaaaatcgcttttaacagcgattcggtgacgggggcttccagcgaacggtgaaatttattgttcaggttagcaacagtgagatgcactttgccatccagcgtatcggcggatggcgcgatcgttgccgcattggctacccacattggcgaagcggaactgacgctggaaagccagtgcggtgcctggcgtgcaactttttccagtacctgctcatcgctaccactgaatcccaactgacgcagcaccggaataaacggacgctcgtgcggcgggatcacggcctgggggaatcccgcatcggcaagttttttcattttcagtaagccctgttttgccgccagtcgcgggttagacacctgaaaacggtgacgggtagaggcttcattaccaaacgacaggcccgcgtaatggtgcgtcagccctaccagcccgtcgaaattgacttcccaggcgttcatcgcaccacctcatcggaaaaatccagcccggggttaagcgttgcgggcaacgttaacgagtccgactccagacttgccatcggccaggcacaataatctgcggcataccaggcgctggggcgatgattgccggaagcgccaatgccgccgaatggcgcggtactggcagcaccggtaagcggtttgttccagttaacaatccccgcccgtgcctccagcaacagttgatcgaatttttcccgctcgggggaaaccagaccgcaagagaggccaaagcgagtgttattcgccattcgaatcgcttcatcgaaattgtcataacgccagacgcgcaataacggcccaaacacttcttcatccggcaagccagtaacgcctgtcatttcaatgatccccggcgtcagcaacgatgtccctgcttgtaataagcgcggcgcaagcagggtccgtccgcccatcgcctccagttcctgccaggcagtaaccacctgctgtgcggcctgctcagaaatcagcccaccaataaatggctgcggttcgtcatcccaagtgcccggcgttaaccgctggctgacggcaaccaggcgagcaagaaatgcatcgccctgcgttccacttttcagaaataaacggcgggcgcaggtgcagcgttgcccggcagtgacaaacgccgactgaatggtcagatggacagcggcatcgatatccgccacctcatcgataattagcgggttattaccgcccatctcaagggcgagaattttctccggctgaccggaaagctggtgatgcagctggtagccggtattggcgctgccggtaaacagcaagccgtcgagatcctccagcgcactcagcgcctgacccgtttcacgcccgccctgcaccaggttcagcacgcccggcggcaagccagcctgctgccataaacgcattaccgcgtcgccactccacggtgtcagttcgctgggtttaaagataatggtgttacctgccagcaatgccggaacgatatgtccgttcggcaaatgaccagggaaattatacggcccaaacaccgccagcacgccgtgcgggcgatgtcgcaggctcgccgcgccgtccggcatttcgctacgctgctcaccggtacgaacgtgatacgccttaattgatatcgcgattttattgatcatcgccgtcacttcggttgccgcttcccagcgcggcttgccggtttctctggcaataatcgcggttaattcggctttattgctttccagcaatccagcaaagcgttcaactcttacctgacgatcgccaaatgagagccgagcccagcgcggaaacgccgcacgggcagcccgacaagcctgcccgacctgagcggcatcggcatcattgccctgccataacacctcgcccgataccggattacgcttcacacgcaatgcgccctggcccgttacccagtcaccgttgatccataaagtcatgctgttttctcctctgcgcacaggcgcaccagacgaacgcgatcccctgcgtggcatttgaggacatccagttgtgcggcggttaaaatcaaacgctcggtcgctggatcggtacgcaccagcaccacgcggaaatggtgataattttcattggcgaccaggcaggccggaaaatcgccctgcgcaggctgcccttcggccacttccaccagccgacttttacggatggcgcgcacgcggtcgatatcacattcaagtgtcggcccgccgtcaaagatgtcgatatagttacggtagcgaaaaccttctttctccagcaccgcacgggcaggcgcggtttgcggatgtacctgaccgatgacgtcctgggcttcctgggataaaaagtaggtatagatcggatgtttcggcatcagttctgcaataaatgccttttgcccggtgccgcagagaaaatcagcgcggctaaaatccatcgaaaagaagcgtttaccgaggctttgccagaacggtgaatagccgtgttcgtcaatcaccccgcgcatttcggcgaccactttgtcattaaacttgtcgcgaaaagccgccataaacataaagcgcgatttcgacagcaaatagccgttgccctctttgcgccacttcgggtcgagaaacagcgtgcacagctcgctgctgccggtgtgatcgttactgagaaacagcgtcggcaatgcgttatagacattcagctctttcgaagcgtgaaccagcgtgccgacgcgatagttgtaccagggatcgttcagcccaaccgccacctcaatggcgcaaatccccgccacagtgcctgtctcactatcttccagtacaaacacataaccctgctcacttttgggcagttcgccttgccaggttttgattgccctttcaatacgcaccgaaagcgtggcttcattggcgggaagcgacgtcaggccgccgcccgttttgctggcaagctgcatcagcgccgagacatctgagcgctcaacgggacgaatgaccatcatgatgaacctcggctaacaaagtgttcgcaagcagctgcaaagcgatccagtccggtcgtcacctcttcttcgctgacattgagcgcaggcgcaaagcgcaccacgttgccacccgcaatcagcaccatcacgcctgctttcaccgcttcctgagagatctgtttcgcttgcccggcgtaatcggcattcagtacacagccaatcaaaagacctaagccgcgaacttcactgaacaaactgtagtggtgattaatggaatttagacgctcaacaaaccagtcgtgacgctgtttaaccccgttaagcatctctggcgtgttgatgagatccagcactttgcctgccaccgccgaggccagcggattgccgccataggtggtgccgtgagtgccaacggtcatcacgctggcgcactcttcggttgccaacaacgcaccaaccgggaaaccgccgcccagcgctttggcggtagttaacagatcaggcgtcacgccgtagtgcatacaggcatacagttccccggtgcgcccgacaccggtttgtacttcatcaaagatcagcaacgcattgtggcggtcacacaattcacgcagaccttgtaaaaatgcgttgctggctggcaccacaccgccttccccctggatgggttcgacaatcaccgcacaggtggcgtcgtcaatcagcgcactggcagagttaatatcgttatatgcagcatgacgaatatccggcggcagtggcgcaaaatcctgtgaataggctggctgcccacccgcactgacagtaaacagcgtgcgaccatgaaacgcatttttgaacgccacgatgccgctcttatggctgccgtagcgatcgtgagcgaatttacgcgccagttttagtgccgcttcgttggcttccgcaccggagttacaaaagaagacgcgatcggcaaacgtggcgtcgatcaattttttcgccagtcgcagtaccggctcgttggtgtaaccgttgccggtatgccagaacttactcgcctgttcgttcagcgcctcacgcagttccggatgcgcatggcccagcgcgttcaccgcaatgccacccgcgaagtcgatatactctttcccctgctgatcccacaagcgtgaaccttcgccacgtaccggtataaacggtgccggagcgtaaacaggtatcatccattcatcaaagttttcacgcgtaattggctgagacatagcgacctctacagtaaataattcgttatttatatgttaataataagtaatgtttgcgctgtaaatgtagattgcagggttcgtgccagccagtgataaaagtgcataaacggcggaggctaactggaaatcaagcagttataaccacatcatatgcatttaaagtgcatataaagtgaatacgtttgcgatgtgggtgaataaaaagaataaaaaacgcaatgttatgcagaagtaaaatataattctggaattgtgatcattgacgaaatttactggaaattactgcgccattctgacgcaacgcgcaccaaaagcgggcattttttgcgccatcgttgacatcattaacaaccatcgatcaaatcacttaacaacaggcggtaagcaaagcgaaattctgctaccatccacgcactctttatctgaataaatggcagcgactatgaaatttgtctcttttaatatcaacggcctgcgcgccagacctcaccagcttgaagccatcgtcgaaaagcaccaaccggatgtgattggcctgcaggagacaaaagttcatgacgatatgtttccgctcgaagaggtggcgaagctcggctacaacgtgttttatcacgggcagaaaggccattatggcgtggcgctgctgaccaaagagacgccgattgccgtgcgtcgcggctttcctggtgacgacgaagaagcgcaacggcggattattatggcggaaatcccctcgccgctgggcaatgtcaccgtgatcaacggttacttcccgcagggtgaaagccgcgaccatccgataaaattcccggcaaaggcgcagttttatcagaatctgcaaaactacctggaaaccgaactcaagcgtgaaaatccggtgctgattatgggcgatatgaatatcagtcctggcgacctggatattggcattggcgaagagaaccgtaagcgctggctgcgtaccggaaaatgttctttccttccggaggaacgcgaatggatggagaggctgatgagctgggggttggtcgataccttccgccatgcgaatccgcaaacagcagatcgtttctcatggtttgattaccgctcaaaaggttttgacgataatcgcggtctgcgcatcgacctgctgctcgccagccaaccgctggcagaatgttgcgtagaaaccggcatcgactatgaaattcgcagcatggaaaaaccgtccgatcacgcccccgtctgggcgaccttccgccgctaatttagctgatctcctggctcaaactgggtcaggagaattaaccttgagaaaaatcaacaaactgtcagtaatgatttgttgcctgccgtcctttgttataccgtcactgcgtttttagttgtctgaccacttctctattatcaagtttgatataggaaactccacgatgaacgctgagcgtaaatttcttttagcctgtcttatttttgcgctggtcatttacgctatccacgctttcggtttattcgatctgctcaccgatttaccccacttacagacactcattcgccagagcggattgttcggctatagcctctatattctgttattcatcattgccaccctctttctgttaccaggaagcatactggtgatcgcgggaggaatagtttttggcccgctcttagggacactactatcattaattgccgccacgctggcctcctcgtgctcattcctgctggcgcgctggctgggacgtgatttactgctgaaatacgttggccatagccataccttccaggccattgaaaaaggcattgcgcgtaacggtattgattttcttattctgacccgcttaatcccgttgtttccttacaatattcaaaattacgcttacggattaaccacaatcgccttctggccttatacccttatttcggcactcacgaccctacccggtattgttatttataccgtgatggcaagcgatctcgccaatgaaggcattacgctgcgctttattttacaactctgtctggcgggtctggcgctgtttattctcgtccagctcgcaaaactctacgcccgacacaaacatgtggatctgtctgcttctcgccgcagcccactttctcacccaaaaaatgaaggatagaacgatgttgcaacattattcagtgtcatggaaaaaaggactggctgcactctgcttactggctgttgctgggcttagcggctgcgatcaaaaagagaatgcggctgcaaaagtggaatacgacggactttcgaacagccaaccgctgcgtgtcgatgccaataaccatacggtaaccatgctggtgcaaattaatggtcgtttcctcaccgacgacactcgtcacggtattgtgtttaaagatggctccaacggacataaatcgctgtttatgggttatgcgaccccgaaagccttttatgaagccctgaaagaggcaggtggtacgccgggcgaaaacatgacgatggataataaagaaacgactcatgtcacaggcagcaaactggatatttcggtcaactggcaaggggcggcaaaagcgtattccttcgatgaagtgattgttgacagtaatggcaagaaactggacatgcgctttggcggtaatttaacggcagcagaagagaagaaaacgggttgcctggtgtgtctggatagctgcccggtcggcatcgtcagcaatgcaacatacacttatggtgcggtggaaaaacgcggcgaagtgaaattcaaaggcaatgcctcagttctcccggcggataacacgctggcaacggttacctttaaaatcaccgaataaagcaggataacggatgatgaagatgcaatcgcgtaaaatctggtactaccgtataaccctcatcatcctgttgttcgctgtgctgctggcatgggcgctgcttcccggcgtccatgagtttatcaatcgcagcattgcggcgtttgccgccgtggaccaacagggtatagaacgctttattcagtcttacggcgcactagcggcagttgtctcgttcttgttgatgattttacaggccattgctgcaccgctacctgcgtttttgatcacctttgccaatgcgtcgctgtttggtgcgttctggggcggcttactgtcgtggaccagttcgatggccggcgcggcgctgtgcttttttatcgccagagtgatgggccgcgaagtggtggaaaaattaaccggcaaaaccgtacttgacagtatggacggctttttcactcgttacggcaaacacaccatcctggtatgtcggttattgccttttgtccctttcgatccaatcagctatgctgccggtttgacttcaatacgttttcgctcgttttttatcgccaccgggcttggtcaattaccggcgactattgtttattcctgggcgggcagcatgttaacaggcggtactttctggtttgtcaccggactgtttattctgtttgccctgaccgtggtgatttttatggcgaagaaaatatggcttgagcgccagaagaggaatgcctgatgggtttaccgccgcttagcaaaattcctttcattttacgtccgcaggcgtggctgcatcgtcgccattacggcgaggtgctaagccccattcgctggtgggggcggatcccgtttatcttttatctggtgtcgatgtttgtcggctggctggagcgcaaacgctcaccgctcgatccggtagtacgatcgcttgtcagcgcgcgcattgcgcaaatgtgcctgtgtgagttttgcgtggatatcaccagtatgaaagtcgccgagcgtaccggcagcaccgataaactgctggcagtggctgactggcggcaaagcccgctctttagcgatgaagaacggctggcgctggagtacgccgaagccgcaagcgtaacgccgccaacggtcgatgatgccctgcgcgcccgactggctacgcattttgacgctcaggcgctcaccgaactgacggcattgataggcctgcaaaatctgtcagcccgttttaattctgccatggacattcccgctcaggggctgtgccgtattcctgaaaaacgttcttaaggagagaagatgcgccattgtgggtggttgctgggattgttatcgctgttttctttggcaacacatgccagtgactggcaggaaataaaaaatgaggccaaaggacaaaccgtatggtttaacgcctggggcggcgataccgcaattaaccgctatctcgactgggttagcggcgagatgaaaacccattacgctataaacctgaagattgttcgtctcgcggatgccgcagacgcggtgaaacgcattcagaccgaagttgctgccggacgtaaaacgggcggttcggtggatctgctctgggtgaacggcgaaaacttccgcaccttaaaagaggccaatttattacaaacgggctgggcggagactctgcccaactggcgctatgtcgacacacagcttccggtgcgggaagatttttcagtgcctacagaaggggctgaatcgccctggggcggcgcacaactgacgtttatcgcccgccgcgatgttacgctacagccaccacaaacgccgcaagccttactggagtttgctaaagccaatcccggcacggttacctatccgcgcccaccggactttaccggcacggcgtttcttgaacagttgctgattatgctaacgccagatcccacagcattaaaagaagcgccggacgatgcgactttcgcccgcgtcactgcgcccttgtggcaatatcttgatgcactgcatccgtatttatggcgcgaaggaaaggatttcccgccttcgcccgcgcggatggatgctctgctgaaagctaacacattgcgcctgtcgctgacctttaaccctgcacatgcgcagcaaaaaatcgccagcggcgatttgcctgcaagcagttacagttttggttttcgcgaggggatgattggcaacgtccatttcgtcaccattcctgccaacgcgaatgccagtgctgcggcgaaggtagttgccaatttcctgctctcacccgatgcgcaactgcgtaaagcagatcccgctgtctggggcgatccttctgttctcgatccgcaaaaactgcctgacgggcagcgcgaatcattgcaatcgagaatgccgcaggatctgccgcctgtactggctgaaccgcacgcaggttgggtaaatgcgctggaacaagaatggctacaccgttacagtacgcattaatctttttgctgtgggcgatgatggcggtgatttatgcaccgctgatcccggcagctctgacgctgatatcgcctgctttgtcgttgacgcactggcaggcgttatttgccgatccacagttaccgcaggcattactggcaacgctggtgtcgacaaccattgcggcggtcggggcgttgttgattgccctgctggtgattgtggcgctgtggccagggccgaaatggcagcgtatgtgcgcccgtctgccgtggctgctcgccattccccatgtggcttttgccaccagcgcccttctgatctttgctgacggagggctgctttatgactatttcccgtatttcactccgccaatggacaaattgggtattgggctgggcctcaccctggcggtaaaagaaagcgcatttctgctgtggatcttagcagcagtattgagcgaaaaacggctgttgcagcaactcattgtgctggattcgctgggctacagccgctggcaatgcctgaactggctgctgttgccctccgtcgcgtctgcgttagcaatggcgatgctggcgattgtcgcctggtcgctgtcggtcgtggatgtggcgattattcttgggccaggtaatcccccgacgctggcggtaattagctggcagtggttaactcagggcgacgccgatcaacaaacgaaaggtgcactcgccagcctgctgctgatgctgttactcgccgcctacgttttgctgggctatctgctatggcgtggctggcgacgtactattccccgcgtagatggcgttcgtaagcctgccacgcctttattgccaggcaatacgctggcgagttttttacccttaaccggtgtgctgtgtgtggttctgctggcgatcctcgcggatcagtcgacgatcaatagtgaagcgctcatcaacagcctgacaatggggctggtggcggcattcatcgctttgctcctgttactgctgtggcaggaatgggggccacagcgtcgccagttgtggctatggttgcccattttattacccgctctgcctctggtggcgggccagtacacgctggcgctatggctgaacctggatggaagctggacggcggtggtctgggggcatctgctgtgggtaatgccgtggatgctgtttatcctgcaacccgcctggcagcgcattgattcacggttaattttgattgcgcaaacactgggctggtcgcgggccaaaatcttcttttacgtaaaatgcccactcatgttgcgccctgcgctgattgccttcgcggtgggattttcagtcagtattgcgcagtatatgccgacgctgtggctgggcgcggggcgttttccgacgctcaccactgaagcggtggcattaagcagcggcggcagcaacggtattctcgccgcccaggctttatggcaactgctgttaccgcttattatttttgccctgaccgcgttagtcgcaaaatgggtaggttatgtcagacaaggactccgctaatgctctgcgtgaaaaatgtttcgctacgtttaccagaaagccgcttgctgacaaacgttaacttttcagtagataaaggtgacattgtcacgttaatgggaccatccggctgcgggaaatccactctgttttcgtggatgattggtgcgctggccggacagttttcttgtacaggggagctatggcttaatgagcaacggattgacatgctacccaccgcacagcgtcagattggcattcttttccaggatgcactgttatttgaccagttcagcgtcgggcaaaatttactgctggcgctaccggagacatttaaggggaatgcccgacgtaatgccgtgaatgatgcacttgagcgttcaggccttgacggagcgttccatcaggatcctgccactttgtctggcggtcagcgagcgcgcgttgctctgctgcgcgcccttctcgctcagccaaaagcgttgctactggatgagccattcagccgtcttgatgtggccctgcgcgataattttcgccattgggtgttcagcgaaattcgcgccatggcgatccctgttgtgcaggtgacgcacgatcttcaggatgttcctcctgatagccccgttctggatatggcgcagtggtcagaaaattacaacaaactgcgataacgcaaagtttttcccgatgcgtcagttcagaatggcgctctcaaaactacaatgtcgggattttcgatgaaacgtgtttctcaaatgaccgcgctggcaatggctttagggctggcttgcgcttcttcgtgggccgctgaactggcgaagcctcttacacttgaccagcttcaacaacaaaatggcaaagcgattgatactcgccccagcgcgttttataacggctggccacaaaccttaaatggcccttccggtcatgaacctgccgccttaaacctctctgctagctggctcgacaaaatgagcaccgaacagctcaacgagtggatcaagcaacataacctgaaagccgatgccccggtggcgctgtacggtaatgacaaagatgtcgacgccgtcaaaacgcgactgcaaaaagcaggttttacgcatatctccatcctgagtgacgcgctaagcgaaccttcccgtctgcaaaaactgccgcactttgaacagctggtatatccgcagtggctgcataacctgcaacaaggtaaagaggttacggcgaaacctgccggtgactggaaagtcattgaagcggcctggggcgctccaaaattttaccttatcagccatattcccggcgctgactacatcgacaccaacgaagtggaaagcgaaccgctgtggaacaaagtttctgatgaacaactgaaagcgatgctggcaaaacacggcattcgccatgacaccacggtcattctgtacgggcgtgacgtatacgctgcagcgcgtgtggcgcaaattatgctttatgccggcgtgaaagatgtgcgcctgctggacggaggctggcaaacctggtccgacgcgggtctgcccgttgagcgcggaacgccaccgaaagtgaaagcggaaccggatttcggcgtgaagatcccggcacaaccgcaactgatgcttgatatggaacaagcgcgtggactgctgcatcgccaggatgcatcgctggtgagcattcgttcgtggccagaatttatcggtacgaccagcggttacagctatattaaaccaaaaggtgaaatagccggagcacgttggggacacgcaggtagcgactcgacgcatatggaagatttccataacccggatggcaccatgcgcagcgccgatgatataaccgctatgtggaaagcatggaatatcaaaccagatcagcaagtttcattctactgcggcactggctggcgcgcgtcagaaacctttatgtacgcacgcgcaatgggctggaataacgtctccgtttacgacggtggctggtacgaatggagcagcgatccaaaaaatccggtagcaaccggtgaacgcggcccggacagcagtaaataacattgcaattactgacgctggagcgacttcagcgtcagatacccactccacacccgcgtaaaggccgtcatccagcacaacgcaccaaatacccacgcaaaccacggaaaacaggccggaaagaggcaactcagaacaaacagcaaaatcgtctcgctgccttcggttaagccgcccagataataaaacgatttatgcgcataaccaggattatcaatctgatgtttcgccgccagcgcagcaaaagcgagaaaactgctgcccgtgccgataaacgcaaacagcagccagccgcctgccagggcgttttgctccggtgcggcgaggataaacccaaaaggcaccagcgcgtaaaaaagaaaatcgagagaaatatcgagaaagccgcccgcgtcggtaagccctctgcgccgcgccagcgcaccgtccagaccatcaagcagcctgttcaacaaaatggcgactagcgccgccagataccagcccagcgccagaaaaggcagtgccagcacgccgatggcaaatcccactaatgttaaaccatctggcgtaatgcccggtttatcaagaacccgcacgcactgatgcaacaacggtttaatccggggatgaagatggcggtctagcacaggcactccttaaatataaagcctttctgattgagcaacagtgcggatattatggcatttttcgcttatctgcccgtgtgtaatttatgaaaatgattgaagttgttgccgccatcatcgaacgtgatggcaaaattttactcgcgcaacgccctgcccagagcgatcaggcgggattatgggagtttgtcggtggtaaaatcgagccggatgaaagccagcggcaggcgctggtgcgtgagttaaacgaagaactgggcatcgaagcaactgttggtgactatgttgccagccatcagcgagaagtttcggggcggattatccatcttcatgcctggcacgtacccgacttccacgggacgttacaggcacatgaacatcaggcgctggtctggtgctcacctgaagaggcgctgcgatatccgctggcccctgctgacattccattattagaggcgtttatggcttcacgcgccgccagaccagcggattagtgcttagggttttgtcatcccgttggcattgcagcagtattccttcggctttaattactgccccttcagaataattttgatcctgataaacgcagcactgagtacagggctgcgctgactgcccgcctgaactgaacacttctggcggtacgtttacctccacgtccggatgataatgcgggttagccagtgtaattaatggaaatgctaatactacggcgatcaatgctcgactcacagggaactccttaacgttattgtctcttctacagataacggtagccgggcggcaaaactttagcgtctgagttatcgcatttggttatgagattactctcgttattaatttgctttcctgggtcatttttttcttgcttaccgtcacattcttgatggtatagtcgaaaactgcaaaagcacatgacataaacaacataagcataatcgtattaatatataagggttttatatctatggatcagacatattctctggagtcattcctcaaccatgtccaaaagcgcgacccgaatcaaaccgagttcgcgcaagccgttcgtgaagtaatgaccacactctggccttttcttgaacaaaatcccaaatatcgtcagatgtcattactggagcgtctggttgaaccggagcgcgtgatccaatttcgcgtagtatgggttgatgatcgcaaccaggtgcaggtcaaccgtgcatggcgtgtgcaattcagctccgccatcggtccgtacaaaggcggtatgcgcttccacccttcagtaaacctttccattctcaaattcctcggcttcgagcaaacctttaaaaatgccctgactactctgccgatgggtggtggtaaaggcggcagcgactttgatccgaaagggaaaagcgaaggcgaagttatgcgtttctgccaggcgctgatgactgaactgtatcgccacctgggcgcggatactgacgttccggcaggtgatatcggcgttggtggtcgtgaagtcggctttatggcggggatgatgaaaaagctctccaacaataccgcctgcgtcttcaccggtaagggcctttcatttggcggcagtcttattcgcccggaagctaccggctacggtctggtttatttcacagaagcaatgctaaaacgccacggtatgggttttgaaggaatgcgcgtttccgtttctggctccggcaacgtcgcccagtacgctatcgaaaaagcgatggaatttggtgctcgagtgatcactgcgtcagactccagcggcactgtagttgatgaaagcggattcacgaaagaaaaactggcgcgtcttatcgaaatcaaagccagccgcgatggtcgagtggcagattacgccaaagaatttggtctggtctatctcgaaggccaacaaccgtggtctgtaccggttgatatcgccctgccttgcgcaacccagaacgaactggatgttgacgccgcgcatcagcttatcgccaatggcgttaaagccgtcgccgaaggggcaaatatgccgaccaccatcgaagcgactgaactgttccagcaggcaggcgtactgtttgcaccgggtaaagcggctaatgctggcggtgtagcaacatcgggcctggaaatggcgcaaaacgctgcgcgcctgggctggaaagccgagaaagttgacgcacgtttgcatcacatcatgctggatatccaccatgcctgtgttgagcatggtggtgaaggtgagcaaaccaactacgtgcagggcgcgaacattgccggttttgtgaaggttgcggatgcgatgttaagccagggcgtgatttaagacaattgtgccggatacagcgcaaacgccttatccggccataaaaatcttcagtatcagatggttgaaagaacctttatgttatcactccattgcccgcctcttctgatggcgggctttttttcggcgctctcttgcgtggcgaatcctttttcttcccttctctaccgccgggagccattattccccgaaactgccttaccgacgtgcgctttgcctgatcaatcaactggtacaatgtccccaccagcggctgcataaagtcctgatagcgacactgcttttcgctgatttgcgtcagcaccgattcccagtgcgcggtcatgtccggtcgcgtcgccatttctggcagcgaatggaatagcgcttttccggcgtcggtggagtggatatagcgcccttttttggtcaggaaaccccgcttgaacaacaattcaataatcccggcacgcgttgcttctgtccccaaaccatcggtcgcacgaaggatctttttcagatctttgtcctgcacaaagcgtgcgatcccggtcatcgccgaaagcagtgttgcatcggtaaaatggcgtggcggctgggtttgccgctctaccacttcgcctttttcgcacaacaattcatcgcctttcgccaccacaggcagcggcgtgccgtcgttttcttcatcgcgctctttgctgcctaacagcgtgcgccagcctgcttcagcaagaaaacgggctttagcgacaaatttgcctttggcaatgtccagttcgataacacacttgcggaacaccgcatccgggcagaactgcatcaagtactgacgggcaatcaggttatagaccttcgcttcgttctccgtcaggttgatcgcagaactccgtgcggtcggaatgatggcgtggtgcgcatcgacctttttgtcatcccaacagcggttgcgtatatctggatctaccactggctgcggcaacagatccggtgcatgaacgctgatagcattcatcaccgcgtggcgtccggcaaaatgttcttctggcaaatagcggcaatcggaacgcggataagtgattagcttgtgcgtttcgtacagcttctggcagatatcaagcacgttctgcgcgctcagaccaaaacgtttagccgcttcaatctgcaacgccgaaagcgaaaaaggcagcggcgcggattctgattcccgtttatcgttatagctggtgacaatagctggttgaccactaatgcggttaaccacatgctccgccagtggacgatgtaacaagcgcccttcttcatcctggtacggttcacacgcttcgctcggttgccagatagcggtaaaccgctcatcggcaggtgtcacgatatgtgctttgacttcaaagaagtctttcgccacgaagttttcaatctcttcgtcgcggcgcaccaccagtccgagtacgggcgtctgcacgcgtcccacggaaagcacgccctgataaccggcattgcgaccgagaatggtatacgcacgggtcatattaatgccgtacagccagtcagcccgcgcccgcgccagtgcagaaacgcacagcggtacaaactcgctattggagcgaagacgatcgatcgcccgctcaaccgcctgcgggttcaggtcgtttatcaaacaacgctgtacctgctggcgcttttccggtgccagttgcaggtagtccagcacttcatccaccagcagttgcccttcgcgatccgggtctccggcgtgaacgatttcgctggcttcatgcaggaagcgtttgatgacattaagttgtttagtcacggagggtcggggctgtaattgccacttttccgggacaattggcaaatccgcaagattccagcgcgcatagcggctgtcgtaggcgtctggctgcgcctgctcaagcaggtgaccgatacaccaggtcaccacctgaccattaccgcactcgataaagccatcgcctttccggtgcggtttaggcaggacatcagcaatggcgcgcgccagactcggtttttcggcaataaacaaccgcattgaattaacggatctcaaccatggcacgaccgccgcgcgctggcaccagttcgccaatcgccgtcagttcaatgccaaactcggcggctgtagctttgacctcattttctgcttccagcatgaccgccagcagcaaaccgccagaagtttgcggatcgcacagcagatcgcgcacttcacgcggcatttcacccatcagatgaccgtagctggcaaagttacgttcggtgccgccaggcactgcgcccaacttaatgtactcttcaaccccaggcaatttcgggatcgcgtcatagtcaacgcgcgcctgcacacctgcgccctgacacatttcgctcaaatggcccagcagaccaaaacccgtaacgtcggtcatcgcttttacgccttcgatgttggcaaaggacgcgcctgcgatgttcatccggcacatcacttccgtcgccagtccctgatgttctggtttcagcagtgattttttctcagccgtggtaagaacgccgatccccagcggtttcgtcaggaacagtttgcatccggcttgtgcggtactgtttttcttcacccgctcggtcggtacgatccccgttaccgccagaccaaaaatcggctccggcgcatcgatggagtgaccgccagccagcgcaatacccgcctgacggcatgcatagcgtccaccttcggttacttcgcgggcaatttccggggaaagtttgttaatcggccagccgaggatcgcaatcgccataatcggtttgccccccatcgcgaagatatcgctgatggcgttagtcgccgcaatgcggccaaaatcgaaaggattatcaacgatcggcataaagaagtcggtggtactgataacgctggtgccattgcccagatcgtacaccgccgcatcgtcgcgggtttcattacccacaagcaaattcggatcaacaaacttcgcctgctcactgtgcaggatggtttccaacacttttggggaaattttacagccgcaaccagcgccgtggctgtattgggtcaaacgaatcgagttctcgctcatggacatctcctgtcaatgcaatccgggtatggtaaccctcattccatgaagtgataagtgagagtgtctgaattcctgcgcctttgctcacaatccagacagtttcgcgacaattatcagaaataagtcacaaacggcgtcgggtccgggacgtttatcgaagtagatgttttcaactgcggcgtaccgaggtagagaaaaccgacaattttatcctgctcacggcaaccgaatgcttcacgcactaccggactttcagttaatgcaccactgcgccagatgccgccaaacccttgggcaactgctgccatttgcatcgccatgaccgcgcatcccgcagacatttcctgttcccagcgcgggactttatgattttcttcgcatttcgccaccaccgttatgatgagcggtgcgcggaacggcgcattacgcgctttgtcgattgctttgttatcactaccggcagcaatcgccccctgctccagtacggcgctgaaacgctcgcgcccttccccttcaatcacaaagaaatgccacggttgcatggacttatggtccggcgcacgcatacccgcacgcaggatgttttgcagttgttcacccgttggcgcgggttcagccaggcgggaggcgctacggcgattgatcaatagttcgagtgcatccatttgattaactcctgtcatgatatttattcacaaaattaacacgagagtggattttgttacagcccagtccgcaattcctgctgacaagtgccggttgggtcattacgataaccacatctattgcgcctgaaacaggtgtgaccttaagttgggagaatacatgcgaaccctttggcgatttattgccggattttttaaatggacgtggcgtctgctgaatttcgtccgtgaaatggtacttaacctgttctttatttttctcgtgctggttggtgtggggatctggatgcaggtcagtggtggtgattcgaaagaaacggccagtcgtggcgcactgctgctggacatttctggtgtgatcgtcgataaacccgacagttctcagcggtttagtaaattaagccgccagctgcttggtgccagttccgatcgtctgcaggaaaactcactgtttgatatcgtcaacaccattcgccaggcgaaggacgaccgcaatatcaccggtattgtgatggatctgaaaaacttcgcaggcggcgaccagccgtctatgcagtacatcggcaaagctctgaaagagtttcgtgatagcgggaaaccggtttatgccgttggcgagaactacagccaggggcaatattatctcgccagtttcgccaataaaatttggctgtctccgcaaggcgtggttgatctgcacggctttgccaccaacggtctgtactacaaatcgttactggataagctgaaagtttccacccatgtgttccgcgtgggtacgtataaatctgccgttgaaccgtttattcgtgatgatatgtcgccggcagcccgcgaagctgacagccgctggattggtgagctgtggcaaaactatctgaatactgttgccgctaaccgccagatccctgctcagcaggtattccctggcgcgcaagggttgcttgagggtttaaccaaaaccggtggcgataccgcgaaatatgcgctggaaaacaagctggtcgatgcactggcatcgagtgccgaaatcgaaaaaactctgaccaaagagttcggctggagtaaaactgataaaaattatcgcgccatcagttattacgattacgcattgaaaacgccggcagataccggtgacagtatcggtgtcgtcttcgctaatggcgcaattatggatggcgaggaaactcaggggaatgttggcggtgataccactgcggcacaaatccgcgacgctcgccttgacccgaaagtgaaagcgattgttctgcgtgttaatagtcccggcggcagcgttaccgcgtctgaagtgattcgcgctgaactggcagcagcccgggcagcgggtaagcctgtggttgtatcgatgggcggcatggcggcatctggtggttactggatttccacaccagctaattacattgtggctaaccccagcaccctgaccggttctatcggtatcttcggcgtgatcaccaccgtagaaaatagtctggattcgattggtgttcatactgatggtgtctcaacttcaccgctggcagatgtttctatcaccagggcactgccgccggaagcgcagcagatgatgcagttaagcattgagaatggctataaacgctttatcacgctggttgctgatgcgcgtcattcaacgccggagcagattgataaaatcgcccagggtcacgtctggaccggtcaggatgcaaaagctaacgggctggtcgatagtctcggggatttcgatgatgcggtcgccaaagcagcagagctggcaaaagtgaaacagtggcatctggaatactacgttgatgaaccgaccttcttcgacaaagtgatggacaacatgtctggttctgtccgggcaatgttgccagatgcgttccaggccatgttacctgcaccgctggccccggtagcctctaccgttaaaagtgaaagcgacaagctggccgcgtttaacgacccacaaaaccgttatgcgttttgcctgacctgcgccaacgtgcgttaagtcttgtactaagtggccgacagatcgtcggccacattactttttacgtcgacgaatcctcttcccgctgtctcgccacatatttccttatcctcatagtatcaggtgcgctccccctgcctcacgtatatacttttgctctttcgatatcattcatatcaatatcatgcaaaagaagtcaatttacgtcgcctacacgggcgggaccatcgggatgcagcgttccgagcagggttatattccggtgtcaggtcatctacaacgccaactggcgctgatgccggaattccatcgcccggagatgccagatttcaccattcatgaatatacgccattgatggattcttctgatatgacgccagaagactggcagcatattgctgaagatattaaagcacactatgacgactatgatggttttgtcattctgcacggtacagacacgatggcgtataccgcctctgcactgtcgttcatgctcgagaatctcggtaaaccggtcattgtgacagggtcacaaatcccgctggctgagttacgctctgacggacaaattaatctgctgaatgcgttgtacgttgcggcgaattatcctatcaacgaagtaactctcttttttaataatcgactgtatcgtggcaaccgaaccaccaaagcacatgccgatggttttgatgcgtttgcctctccaaaccttcctccgttactggaagcaggtatccatattcgtcgtttgaatacgccacccgtcccgcacggtgaaggggcattgatcgttcatccaatcacgccgcaaccaattggcgtagtgacgatttatccggggatttctgctgacgtcgtgcgcaattttctgcgccaacctgtgaaagcattgattctgcgctcatatggcgtgggtaatgcgccacaaaacaaagccttcctgcaggaattacaagaagccagcgatcgcggtattgtggtggtcaacctgacacaatgtatgtccggtaaagtgaacatgggtggttatgccaccggtaacgccctcgcccatgccggcgttattggcggtgcagatatgactgtagaagccacgctaaccaaactgcattacctgcttagccaggaacttgatactgaaaccattcgcaaggccatgagccaaaacctgcgtggcgaactgacgccggatgattaaggagactgcaatgccccctcgcgccctgttactggtcgatttacaaaatgatttctgtgctggtggcgcgctcgccgtgccggaaggtgacagtacggtggatgtcgctaaccgcctgattgactggtgccagtcgcgcggtgaagcggttatcgccagtcaggactggcacccggcgaatcacggcagttttgccagtcagcacggtgtagagccttatacgccgggccaactcgacggtttgccacaaaccttctggcccgatcactgtgtgcagaacagtgaaggcgcacaattacatccgttactgaagcaaaaagcgatcgcagcggtgttccataaaggcgaaaatcctttagttgacagttacagtgccttttttgataacggccgtcggcagaaaactgcgctcgatgactggttgcgcgctcatgtaatcaatgaattgatcgttatgggtctggctactgactattgcgttaagtttaccgtgctggacgcgttacagttaggctataaggtgaacgtgattaccgatggttgtcgtggcgtaaatatccagccacaggacagtgcgcacgcgtttatggagatgtcagcagctggggcaacgctatatacgctggcagactgggaagaaacgcaggagtaattttacgctggcctacaattctgtactggcattgtaggccagataaaacacatcagtgatacatctggtaattgacgccatcaacgaaagatttaattcacctcagaaatctcttccagcgacaccttccgcgtttcgatgccaaaaatggagagaaccagcgcacagagcactaacatgacaccaagcaccataaacaccgtgatcgacccataatatgttaataatgccgcaacgccatagggcgtgaagactgcgacgatccgtccgacggcattaacgaaacccgaaccacgcaggcgtaaatgcgttggccaaagttccgggatataaaccgccgacgcgaagcacacatacatgtataaaaagaagatcatcaccaggccatagattaaaatcgcccactctgtagtctgaattgaatagatatagcctaacacagcaataataataagtaaggcagagccaaataatcgacgaggaaaatgatcaataattaatgccgcaataaatatccctaccggcgcgccaatcataataacagcggtcattaatattgatttatcaacatcaatgccggagttaacaaatatggtcggtatccatacggtgatggtataaagcgaaatgttcattgcaattaaaacagtaatcgcgactaatgtacgtcgtaacatttcccctttaaacaggagccagaaggtacccttgattaccttaaccttgctgttgctctggttcaaagtaagcgggggtaaacgaatcctcttctctctttcaatttgctgctctacttcacgaagttggctttctgcacctgcgatttgccctttccctgccagccatcgtggcgactcaataaagtatttacctgagagaaaccacgctaacagtatgccaataccgcccagcagaaacattatccgccaactaaaaaaagcgataaccaccacgcctatcgccgcagagagaatgggcgaccagttaccaacaaatgagagccgcgcggaccattttccacgcaccgtcgcggggataaactccgtaaatgaggcgtagccaaccataatcagcgcccccattcctgttcccatcaagaagcgaaagaagatgagccagtacatatcagggacaaaagcggcccctgttgccgcaataccgacgatgagaagatttatgcgaaacgccctgcgccgcccaaagtagtcaccaataaacccaccggtaagagagccgatgaaataaccaaacattaatgccgaggtaaaggcggcattgaggaaattatttgaccatccattgcttaccagctttgctaagacgacattaccggagtaactcaaaaaccccgttaataacagactaaagcttattataccaaatatacgataatgaaaccgggccaaaggcaagcggtccagtcttgcgccaatttgatcatattgttccattgggtgcctcggatttgctaaaaaaggtagcaattgcggcaaattcacttgccgcatctttatcatcattttatttccaggcgcaggaacaaataatattgacaatgtgtgcttaaattaccacaccagctggatattattgtctttgcaaaatgctatccactctgcacccggtgatttatcagttattatgtaattaatatgactaaagtcagctaactggacaaaagctttgcgatcaaacttagagtgatcaaccaataacgcaacttctgtcgcctgacggatcattgtctttttgatttcagcttccgcttcattagagtccagcgcgccgctgttaatatcaagacctttacaactcattaccatgatatcgacatggtagcggctgatgatctctttagtaattcttccttgcagtgaaagtgtatttttgtttagttccccacccgttgaaacgactttaatttctgactgagccagaacatgaatcgcttccgccgagttggttagcaacgtcaggtcactacggtcctgtaacaatttgagcaattccattacggtactactggaatcggctgccatggtggttttattgtcgataaagggtagtgccttgcgtgcaataagctgcttctcttcataaaacgatgaagcgcgcttataaaaatggatattctccgtcaacatcgctgtatttaaaacagcaccaccataggttctggtcaaaaagccttcatcttccaacttctcaagatcgcggcgaatggtttcttcggttacctgaaaaatcccactcaaatttgagactgtcacctttttatcgttggcaaccatttgcttaattgcctgaatcctgtcttttgccgccacgattacacccctgtatctttttacatcacattagcgcaattatcgcataaccgatgtttactttcaaaataacctgtttgaatcacagattttcatcacagttttcacagaaacagaggtgaatcgtgttgagtatttaacgctccagggcctctgccatttccctcatcaatgttgcgtctgcatccgataagttgatattcagtgccgcgacattttcacgtacctgttccggcgcagtagccccactaagaatggagattaaatcactctgttttaatatccacgccagtgccagagtgggaattgtgcactgataacgagcacagagtggctgccactgttcaagcatatcaatcactttcagcatgttttcacgctggaaccagactttatttgcccgagcgccgcccggaacgtaatcacgcgtgatggtcccggtcaacaatccctgctctagcggagagtagacctataccacaatgccattatcacgacatagcggcagcagttcgttttccattgcccggtcgaggatactgtatttcgcctgaataatatccagttcaccatgttgcagatactcgcggatatggtcagcatcgacgttagcagcgcctatagcgcgaattttcccttcggcctttaacgcattaagcactgcgacagtttcagctatcggcgtaaaaaatggcggcaccgactgccagtgcgtcatgtagatatcgatgtaatcaatacccagacgttgcaagctggcttctacctcttcgcggatagattccggagaaaggtttttatacaactgtcgatcgccaactttgttgaataaactcccttttcgttcccagacaatgccgcatttggtttctactacaacctgttcacggggcagtttttttaacgcctgaccaacgataacttcactattgccaaagttatatcctggcgcagtatcaatcaggttaatgccgcaacgatgggcttcaagaatcgtatcaatgcatatttgtcgatcgagatcgccattccatgcaggaccgccgccaatggcccatgtccccaaccccattcgcgaaagcgttatatccgttgtgcctaaaggtatctttttcatttgccttcattatccttcgtattcttccagcaattgttcgaccagctttctgttttttacaccggtggtggcgccgatgcttagaaccgagatagccgccgttgcattggcaaagcgtgcgcattcacgcagatttttaccttctaacagtgctgcaataaaacctgaagcaaagttatcgcccgcaccaatggtgtcgatagcggttattcctgcgaccgccggcaccttcatcgtcatgtcaccacgcttgataaagcagccgtctttacccgttttaatcaccaccgtttttacgccgcacgcaagaaagcagtcagcaatttcatccagtgtctctttcccggtgagtaattttgcctcggcaaaattaggaaacagataatcgacataactcaatgcttcgcaaatatcattcagcgtttcattcaaccgcggtttgatcatatcggcacagataatcatctgccgggttttagcttgcgtaaaaatttctgttagcgctctaccatccaatagaggactgttgaaaatactggccagtgataataatttcgcctgagaaaaccgcgcaaaatcaacatcgtcaatattcaatttccacagactgccgttacggtttgtgacaaaggtccgctcaccatcctccgtcaccagtccaacgttaatagaggtatctatgctgacgtcctgcttcaggctttgaatatcaatattctctttgcggcaatggtcgagaataaattgccctgcggcatctttaccaatacgactcattaatgctgtgcgatggcccagacgagaaataattgttgcttcatttattgcatcccccccggtggtcattgcgattctttcaagaggataagaatccacatcaaagatatttttactgaccggttgcaatggaatatcaacaatagcggcacctatacaaataacgtcgagattatccatattattattccgctttgccatcagaaccgaacagtttaattttatccaatgcccgttcttttatagctttacgcacttcacgttctaaatgcaggaaaggctgatcctggttttctttcactgctaccattgcggcctgacagagctccgtatgaatgttgattttcgcaatacccaacgaaattgcagttttaatgtcggcatcactgatccctgatgcgccatgcaaaaccagcggaacagaaacagcatcgcgtacgcgtttgacgacctcaaagttcaattgtggctctgacgtataaaccccatgctggttgccgatggcgacagccaatgagtcacagcccgtacgttcaacaaattcagccgcctggtcaggatcggtatagtgatagcccgcccgcgcttcctcataaacggtttcattaccgacatgcgctaattccgcctctaccggaatacccagcggatggaagaaatcaacagcctctttggttaaacgaatattttcttcgaaatcaaatgcagaagcatcacgcattaatgaattcataccatgagtccaggcgttatgaataatctccatactccgaccatgatcccaatgagttattaccggcaccgttgctttttgtgccattgataccatcatgtgagagaaatcttcaaatgaggtgttgccgacaaaacctgtgccaaaagaaataataaccggtgatttcgcttcttcggctgcgtcgataacgcccatcaacatttctgcattccatacgttaaaatgggcaattgcataatgtttatttgtggcatcgttttcccaatatctgatatctgcgagcatgttctgttctcccgtattaattaatcgctaattttaataacgcctttaataatgtcgcgtttgttgttaactgactcttcaaatgcctgttgtacatcccgataatcgtaaatatgcgtcaccatcgatttcacatcgaatcgccctgaggaaatagcttcaatcgtgaccggataacgattggcatagcggaataccgtctggatagtgacttcgcgattgattttgaggaaattgattgccgaatcgccgggtacagtaccaacaatcataattttaccgccgcgcatgaccagataaggtgcctgtttaacggtgaccgcagaacccgctgtttcaaaaacaatatctgcgcccatgtcttcggtaaattgctgacagcgtgcaatagtgtcttcttttgcgccgttaataaccactgtcgcgccgagctgttccgccattgtcagacgtttttccagcacatcaacgacggcaatttccgttgctcccaggcatttgcacgcttgcaacgtcatcaaaccaatacaacccgctcccagaataattatcttcttaccaggtttaacatctgccagcatcgcggcatgcatcccgactgcggcaggctccaccagcgccccttccatcgtgtccatattgtctggcagtttgtaagtaaagctctccggatgacacagatagtgcgttaatgcgccgcggtagttgggttgtgtcgccataaaatcaacgtccgggcagatgttatatttgccttccagacagtaacgacagtgaccgcaaggaacgccaggttcgatatttacccgatcccccggtttaaatttgcgcacgcggcttcccacagccacaaccgtcccggcacattcatgacccaggccaatttcttgatttgggtctttaggaggaataaacgggcctgattcaaaaccatgtacatctgaaccacaaataccgacatattccactttaatcaaaacttcatcttctttaggcacaggtatttctgctgaaataattttcattgtgcccggcacctgcaatattgcttttgaatttttcattttgaatccaccagtattatttattggctactgcatcaatacttaaactttcaacggagacacctttggtttcaattccaatggtggcgatagcaattgcgacaataattgaaacagcccccagaagaataaagactcccgttacgccataactactgagcagcactgcaacggcataaggcgcggcaataccactgattcgccctaccgcattcgccagaccggagccacggagtttggcctctgtcggccagatctcagggacatacactgccgaggcatagcaaacgtacatatagacgaaagtaatcaggaagaaaccaatcagcgttatgagcaacatactggtttgcagtgaatagatatatccgagcaccgcaatcaggattaatagccccacacccattgttttacgcggaattttatccatcaccagcatggcaataaaaataccaaatggcgcgccaaacatactcatggtatttaaaacaatcgagtcttttaaattaattccctgggtcatgaatatcgttggcaaccagttaattagtgtgtactgcacaacgttcatggcaatcagcacacaagagcctaatatcacgcgtttcagtaatactcctgtcagtaaggctgaatacggcaccgcttgtggtgctttaccgtcatcagcaataaccacaggcggcaaaggtttacccgtctggcgtatgacgccttcttctatactccgcatgactttctcggcttcctgataccgtccgcgcgattccagccagcgcggggattcaggaaagtagcgccaggccagcgccgtagcgataagtgacaatattgcagggataagcagttgtacccgccagttccactctgcactaatcagcggcgtgagtcccatcgcaatcaatgaacagagcggatatgaccagttaccaataaaggaaacccgactggaccacgttccgcgatttcttccgggcatatattcggtgaaaccagcaaacagtgtaaccagtaaagctcccagcccaacgcccatcacaaaacggcaggcaataaggaaatccatattcggtgagaaagcaccgacaaccatcgaagcaatatgaatggcctcatagaggataaacgcatttctgcgaccggttttgtcaccgatgatgccgcccaccagcgcaccgagaaacattccggcggtcgtgattgctgagaatgtggcagtggtggaattatctgtccagcccaacgctttcagctgcgcgaggatcaagccaccaacggcattactccagcagacaagcaagccaaacgcgacgatggcaaacatcgacgaatgccagcggcaatccggtaagcgatccagccgtgcaccacaatgcggttttgttatctgttccatgcgataacgttccttcaggagagtagttattcatcaaagtcgtaagtcatgatcactttgattgcagttttatcgaccatcgcatcaaacccttcgcgccattgcgacaggccgatacgatgcgtgatcatcggtttgactttgatcgcgccgctggctaatagcctgatagcgttacgccatgaggtggagtcataggccatatgcccaatgatgcttttgttccaggcggtaatgtcattaatcgagaaatcaagaggtttgaagcccattccaacgcgtaccacttccccgttcggacggagcatttcgatggcttgtttcagtgcgatattggcaccggagcattcaatcaccagtcccagattgtctttgccacaaatttgctggcagcgcgccaccacatcttcggtagaaccatttactactgccgtcgcacccagttcttttgcaaccgggaagcggaccgccacatcttcttgtagaccaacgacgacgatatttaccgcccccataatccgcgccatttgtacggagaacagcccgagtgggccagtgccgatgacgaccacatcctgaccagggaggaatttcgattgctgcgcgatggatttgtaggcattacagatagggtcaagtacggctgcgtcctcataatcaacaccatcagggatttcccacaacgcatgacgatgaattttgagaatttcaccaggaacaagacaatatttggaaaaaccaccgccccaggtattgttatccagaccaaggtttactttttctgtacaacacagaaaatcaccttgttcacaggccgggcaaacaccgcaaacgtgaccgctgttatccgacacgacgcgttgccccactttccagtctttgactttttcaccaacctgcgcaatacaacctgcgaactcatggccgcggatagagttaaactcatcagaaccgctatcgacattgtagtgcttcatgtctgcgccgcagattgccgcggctttaatttcaatcacgacatcttccgggccacaaatgggttgtgggacatcaatcatcttgtagccgccaaaggccttgccaaaccgagccagtgctttcattgcgtcatcctctgtgttttgttttgcttagatggtcatcatacttacccacatgatttttgaggtcaacattaaatctgtaaaacacagataattatctgcgttttacaacttagatcacaattacgcagaaaatggctggggctgttacaggttgatggaaggcgggacgcaaaaagagcaaattcgagagggattaccggccaaataggcctgagacttaagttcaggagaagtcattcaggtgagaacgcgactgcaagagatcggactgggacttagccaggtcggggcgagataattgagatgagtcgtggggtcattgttggctatcccctttataaccgcggcaaaaaggggataaaccacttacttaaacatggtaataggctttgctgagataccaaaatcttcttttaactgctgtttgctcttcatgaccatctgaccatttgtgtcaattgtcatatgctgtgcttcggtattatggcgggcttgccacagcatcaccagttgcaggcagttctctttttgttcctcggtcaacgtaacgccatcaggccatttccccagttcaacggcggtcgacaaacgctggtatacttcaggcgtcatgctgttgataatgtcctcaagattcataatttttccgctcctgtggaataagttgctgaatcgttttttcaaccgttgatttcttcgccgttttcgccatcagtgaagcgtaaagaagcagagttaacacaataacgttcgcccgttggatgcggcccgtcagggaagacatggcccagatgggcatcgcagttaccgcaacgaatttctatgcgctgcattccatgtgacaagtctttgatataacgaatagattcttcactcaccggttcgtagaaactgggccagccacagccggaatcatacttggtttgggaatgaaacagcggggcatcgcagatcaaacagtgatatacgccgtcacgcttgttatgcagtaaacgacccgtaaatggcggttctgtcccatgattctgcgtcacgtagaactgcatctcggacaaattttttttcagttcttctgccgaaggtttattagccatttgctcacatctcactttaatcgtgctcacattacgtgactgattctaacaaaacattaacaccaactggcaaaattttgtcctaaacttgatctcgacgaaatggccgcacctaaattgtgatgaaaatcacatttttatcgtaattgccctttaaaattcggggcgccgaccccatgtggtctcaagcccaaaggaagagtgaggcgagtcagtcgcgtaatgcttaggcacaggattgatttgtcgcaatgattgacacgattccgcttgacgctgcgtaaggtttttgtaattttacaggcaaccttttattcactaacaaatagctggtggaatatatgactatcaaagtaggtatcaacggttttggccgtatcggtcgcattgttttccgtgctgctcagaaacgttctgacatcgagatcgttgcaatcaacgacctgttagacgctgattacatggcatacatgctgaaatatgactccactcacggccgtttcgacggtaccgttgaagtgaaagacggtcatctgatcgttaacggtaaaaaaatccgtgttaccgctgaacgtgatccggctaacctgaaatgggacgaagttggtgttgacgttgtcgctgaagcaactggtctgttcctgactgacgaaactgctcgtaaacacatcaccgctggtgcgaagaaagtggttatgactggtccgtctaaagacaacactccgatgttcgttaaaggcgctaacttcgacaaatatgctggccaggacatcgtttccaacgcttcctgcaccaccaactgcctggctccgctggctaaagttatcaacgataacttcggcatcatcgaaggtctgatgaccaccgttcacgctactaccgctactcagaaaaccgttgatggcccgtctcacaaagactggcgcggcggccgcggcgcttcccagaacatcatcccgtcttctaccggtgctgctaaagctgtaggtaaagtactgccagaactgaatggcaaactgactggtatggcgttccgcgttccgaccccgaacgtatccgtagttgacctgaccgttcgtctggaaaaagctgcaacttacgagcagatcaaagctgccgttaaagctgctgctgaaggcgaaatgaaaggcgttctgggctacaccgaagatgacgtagtatctaccgatttcaacggcgaagtttgcacttccgtgttcgatgctaaagcgggtatcgctctgaacgataacttcgtgaaactggtatcctggtacgacaacgaaaccggttactccaacaaagttctggacctgatcgctcacatctccaaataagttgagatgactctgtgatctaaaaagagcgacttcggtcgctcttttttttacctgataaaatgaagttaaaggactgcgtcatgattaagaaaatttttgcccttccggtcatcgaacaaatctcccctgtcctctcccgtcgtaaactggatgaactggacctcattgtggtcgatcatccccaggtaaaagcctcttttgcattacagggcgcacaccttctctcgtggaaacctgcgggtgaagaagaagttctgtggttgagtaacaacacaccgttcaaaaatggcgtcgccattcgcggtggcataccggtttgctggccgtggtttggtccggctgcacaacaaggtctgcctgcgcacggttttgcccgcaacctgccgtggacgctgaaatcacatcgtgaagatgctgatggtgtagcgctgacttttgaattgacacaaagcgaagagacgaaaaaattctggccgcacgactttacgctgttagcgcatttccacgtgggtaaaacctgtgaaatcgatcttgaagcacacggcgaatttgaaactacctctgctctgcatacctactttaacgtgggtgatatcgctaaggtaagcgtcagtggactaggcgatcgcttcattgataaagtaaatgacgcgaaagaagatgtactgaccgacggtattcagaccttccctgaccgtaccgatcgcgtgtatctgaatccgcaagattgcagcgtaattaatgacgaagcgctgaatcgtattatcgccgtaggccaccagcatcatctgaacgttgtaggctggaacccaggaccggcgctttcagttagcatgggcgatatgccggatgatggctacaagacctttgtttgtgtagaaacggcttacgcttcagaaacgcaaaaagtcaccaaagagaaacctgcacatctggcgcaatccattcgcgttgcgaaacgttaatttgcgttaatattgtgtgccgggtgcgatgcatccggcacgtatcaacatcacaccatatccagcgcagtttttccttttggtgccggatacgctttatccagcataactaattccgctgacgaaagttcaacctcaagcacagccgcattttgttggacatgtgcgacagttgccgcttttggaatcgccatcacaccctgatggctgattacccacgccaacaatacttgtgccgcactgatattgtgagcatgtgcaatttcgttgactaccgcgttttttaacagtccattgcgcaaccgcccggcctgggctaatggactgtaagccatcaccggcatctgctgtttctggcaccagggaagtagatcgtactcaatccctcgtgaaccgagatggtaaagcacctgattagtggcacactgatttccccccggcagctgccagagttcctgcatatcggcataatcaaggttagaaacgccccagcggcggatttttccctgggcgatcaatttttccatcgctgcgacagtctcttcgagagcgaaactgccagaccagtgtaataagtagagatcgagataatcagtattgagacggcgtaaactggcttcgcatgcatttatcgctttttgcccgccagcattccacggatagactttagagacgagaaagacgttctcacgcagaccgattaatgcttccccaaccactttttcggcaccgccatcggcatacatttcggcggtatcaatgagggttaaaccgagttcaatgcccgcgcgtagtgcagcaacttctgttttacgctgactggcatcttcgcccatataccatgttccctgccctatggctggcaatgagacatcgccactaaattgaatcattttttgttgcattgcttcctcccaggtattgcaccaccgtaatgcaaaacagggcattacgccctgtttttatgcacaaaatgccctggaaaaatgcattatcagaatttgtaggtgatcccggtagaaatcaggccagtccaggatttatccaccattgggctgtcagtaacttcatcagacagacgggtgtagcgcgcggtaccgtaaacactccagtcaccgaggaagttgtagctggcgctcagctccaggtaagggctccagctgtcgttcgggttatagccacgcagaccgctgcgagcggactctttgcgcgatacgccataatagtattcgttctggttttcgctgttccactgcacaccaatacccggagtcacggtcaggccaccgttggtgtaacgatacaaccaggccatatcccagacgatgccgttgctgttatccagggtatcgccagccagggtggtacgcaggtaaccgtactgggtaaagtgagcataagacagaccagccatcatggtgctcttacggtcatccaggtgacgcatttggtgatcgccactgtctttagctttgaagtaaagcggcgaccagtaagcggtaattgaaagtttgtccgttgcgtcattccacaggtagtaaccaccacctaagccacggaaccagaagttatcgccttcatagttgattaccggtactgggtaaacatcggtatcgtaatctttatatgggtgttcaacgacacctacgcctgcgcccagggaaaatttaccttcagcgtgcgttacgcctgcagacgttgcgataagcactccaagtgccagaagtttgagtttggtcacaattaatcattccttaaacaaatgtttagcgggcgacaaagtttacccgtcaatacatcgaaacccaacctttttacgttttcattttttatagtaactgtttaattttcctgacgcagatgacaccacgcttacagccaaatgaatttagcgttaccggcgactctattatttacattaattatgcaaaatttatggatgagttgttgatatgccattgaaattaagaacgccgtgcaggcaagttttccatttgccatctacgcttaattttgaaggtgtatcaccgggcacgttgttctcatcgtcaataaaatggcatgagagttgctgtgttttagcaagagacgtcgttcagtttacctcttccgggagcctcaactattcatatgaacggctcttaacctgtgctaaaaaacgaaaggacggcataccatgaatatattcgatcactatcgccagcgatatgaagctgccaaggacgaagagttcacactgcaggagtttcttaccacttgtcggcaagatcgcagtgcttatgccaacgcggctgagcggctattgatggctattggtgagcctgtcatggtcgatacagcccaggaacccagactttctcgactcttttctaaccgggtcattgcacgttatccggcgtttgaagagttttacggcatggaagacgcgattgaacagattgtatcttatctgaaacacgcggctcaggggctggaagagaagaaacaaatcctgtatctgctggggcctgtgggtgggggtaaatcatcgcttgctgagcgactgaaatcattaatgcagctcgtaccgatttatgtattgagcgccaacggtgagcgtagcccggtcaacgatcatccgttctgtcttttcaatccgcaggaagatgcgcagattctggaaaaagagtatggcattcctcgccgttatctcggcaccatcatgtcgccgtgggcggcaaaacgcctgcatgaatttggtggcgatatcactaagttccgggtagtgaaggtctggccgtcaattctgcaacaaattgctatcgccaaaacagaacccggcgatgagaacaaccaggacatctccgccctggtagggaaagtcgatattcgtaaactcgaacactacgcgcagaatgacccggacgcctacggctattccggtgcgctgtgccgcgccaatcaggggatcatggaatttgtcgagatgtttaaagcaccgataaaagtgctgcatcccttgttaaccgccacccaggaaggtaactacaacgggacggaaggtatctccgccctgccgttcaacgggattattctcgcccactcgaacgaatccgaatgggtcactttccgtaataacaaaaacaacgaagccttcctcgaccgtgtttacatcgtgaaggtgccgtattgcttgcgcatttccgaagagatcaaaatctacgagaaattgcttaatcacagtgaattgactcacgccccctgcgcccctggcacgctggaaacgctgtcacgtttttctattctttcgcgtctgaaagagccagaaaactccagcatttattcaaagatgcgggtttatgatggtgaaagtttgaaagacactgatcccaaagccaagtcgtatcaggaatatcgtgactacgccggtgtcgatgaagggatgaacggtctgtcgacgcgttttgcgtttaagatcctctcccgcgtgttcaacttcgatcatgtagaagtggcggcaaacccggtccatctgttctacgtcctggaacagcagatcgagcgcgagcagttcccgcaagagcaggcagaacgctatctggagttcctgaaaggttatctgatcccgaaatatgccgagtttatcggcaaagagatccagacggcctaccttgaatcctattcagaatatgggcagaacatttttgaccgttatgttacctacgcggatttctggattcaggatcaggagtatcgcgatccggataccgggcagctgtttgaccgcgagtctcttaacgccgagctggagaaaatcgagaaaccggcggggatcagtaatccaaaagatttccgcaacgagattgttaacttcgtactgcgagccagagccaataacagcggacgtaatccgaactggaccagctatgaaaaactgcgcacggttattgagaagaaaatgttctctaataccgaggagctgttgccggttatttcgtttaacgccaaaacgtcaaccgacgagcagaagaaacacgacgactttgtcgaccgtatgatggaaaaaggctacacccgtaaacaggtgcgtttactgtgcgaatggtatttgcgcgtacgtaaatcgtcttaacaaccctggcccggtacacatgctaccgggcctacaacgacagcgaaccgtgggccagagaagcggcaacacaggcgtagcataccgttggcaaatgtagtacggggggcatatgacctggtttattgaccggcgtctgaacggcaaaaataaaagcatggtgaatcgccagcgtttcttacgccgttataaagcgcaaattaaacagtcgatctccgaggccataaataagcgttcggtgactgacgtcgacagcggcgagtccgtatccattcccacggaagatattagcgaaccgatgtttcatcaggggcgtggtggcctgcgccaccgcgtacatccgggcaatgaccatttcgtccagaacgaccgaattgaacgtccccagggtggtggcggaggttccggcagtggtcagggccaggccagccaggatggtgaaggtcaggatgaatttgtctttcagatttcgaaagatgagtatcttgatctgctctttgaagatttggccttaccgaatctgaaacaaaaccaacaacgccagctgaccgaatataaaacgcatcgggcgggttataccgctaacggcgttccggccaatatcagcgttgtacgttcattgcagaactcactggcgcggcgcacagccatgacggcgggcaagcggcgggaacttcatgcactggaagagaatttggccatcatcagcaacagtgaacctgcgcaactgctggaagaggaacggctgcgcaaagagattgctgaattgcgcgccaaaattgaacgcgttcctttcattgacactttcgatttacgttacaagaactacgaaaaacggcccgatccctccagccaggcagtgatgttttgcctgatggacgtttccggttcaatggatcagtccactaaggatatggctaaacgtttttatattctgctgtatctgttcctcagcagaacgtataagaacgtggaagtcgtatacatccgccatcatacccaggcgaaagaagtcgatgaacatgagtttttctactcgcaggaaactggcggcaccattgtttccagcgccctgaaactgatggatgaggtagtgaaagagcgttataacccggcacagtggaatatttacgcagcccaagcatcagacggcgataactgggccgatgactctccgctttgccatgaaattctggcgaaaaaaatattacccgttgttcgttattacagctatatcgaaattacacgtcgcgcgcatcagactctgtggcgagaatatgagcatctgcaatctactttcgacaactttgcgatgcagcatatccgcgaccaggatgatatttatccggtgttccgtgaactgtttcataaacaaaatgcaacagctaaagactaaaactgtcagccgggtcattatcgcctggctgatttttagctcactgtaaattatctcatttattacatacattagcttacaatcgctttaaatatgacagcataacctttacacaatttagttccagaaaacaatcattcggaaaaatgattcggtcaacacgtatttccctggggttattctttaattattttttatcgttaacgaaaattgatcttggtcaaaactatatatctctgccatcaataaaatccagcactcacattgctctcctttttatggtttctatgggtacacaaaaattaaaagctcaaggcttttttattttcagcttattgctgacgttaattttattttgcattactaccttatataacgaaaacacaaatgtaaaactcatcccacagatgaattacctgatggttgttgtggctttgtttttccttaacgccgtcattttccttttcatgttaatgaagtatttcactaacaaacaaattttaccaacactcattttaagccttgcatttttaagtggccttatctatttagttgaaaccattgtaattatccataaaccaatcaacggcagtacactgatccagacaaagtcgaatgatgtttctattttctatattttccgccaactcagtttcatttgtttaacctcgctggcgctcttttgttatgggaaagacaacatccttgacaacaataagaaaaaaactggcattctgttgctggcgctgattccttttttagtttttccccttctggcacacaatctgagcagttataacgctgactattctttgtatgtcgtcgattactgtccggacaaccatactgcgacctggggaatcaactatacaaaaatattggtttgtttgtgggcatttttactgttctttattatcatgcgtacacgattagccagcgaactatggccgttaatagcattattatgtctggcatcgctatgctgcaacttacttctactgactctggatgagtataattacaccatctggtatatcagtcgcgggattgaagtttccagtaaactgtttgttgtgtcttttctgatttataacatttttcaggaactgcaactctccagcaaactggcagttcatgatgtactgaccaatatttataatcggcgctactttttcaacagcgtagagtcattattgtcgcgacctgttgttaaggacttttgtgtcatgctggttgatattaatcagttcaaacgcatcaatgcccaatggggacatcgtgtgggtgataaagtgctggtatcaattgtcgatattatccagcaaagcatccgccccgatgatattttagcgcgactggagggtgaggtgtttggcttgctatttaccgaactcaatagtgcccaggcaaaaatcattgcggaacgtatgcgtaaaaatgtcgaactcctgaccggctttagtaacagatatgatgttcctgaacaaatgaccatcagtattggcacggttttttcaacgggtgacacgcataatatctcgcttgtcatgacggaagcagataaagccttacgcgaagcgaaaagcgaggggggcaacaaagtgattattcatcatatttaagtgcaaaaatattcacagccatgctttttgcgtggcttttgcatacaatttattactattacccctaaatttcccctccccagcggcgcagagatgagtataattagcgcccctgtgccaggccgcaatcgaactttatctggttttctcgtttcactaaccgaaggagtgccatttatcatgaaattgcaccatagaatgctccggcattttatcgccgcaagtgtcattgtgctgacatcttccttccttatttttgaacttgtcgccagcgacagagcaatgagtgcctacctgcgctatatcgtgcagagagcagactcttcctttctttatgataagtatcagaatcagagtattgccgcgcatgtgatgcgcgctctcgctgctgagcagtcggaagtgccgccagaacagcggcgcgccatctgcgaggcttttgagtctgccaataatacccatggcttaaacctgactgcccataaatacccgggcttacgcggcacactacaaaccgcatccactgactgcgacacaattgtggaagctgcagcactattacccgcttttgatcaggcagtggaaggcaaccgccaccaggatgattacggttcaggtcttgggatggccgaagagaaatttcactattatctcgatctcaatgaccgctatgtctatttttatgagccggttaatgttgaatactttgcgatgaataactggtccttcctgcagtcaggaagtattggtatcgatcgcaaagatattgaaaaagtatttaccgggcgtaccgtattatcgagcatttactaggatcagcgtactaaacagaacgtgatgagtttgctgacgccggtatatgtcgcagggcagctaaaagggattgtgctgctggatattaacaaaaacaatctgcggaatatcttttacactcatgaccgccctctcctctggcgttttctcaatgtcacgctaaccgatacagattcggggcgcgacattatcatcaaccagagcgaagataatctgttccagtatgtcagttacgtccatgacttaccgggcggcattcgtgtctcgttatccattgatattctttactttatcacgtcttcgtggaaaagcgttctgttctggattttgacggcgttaattttgctgaatatggtgcggatgcacttccgcttataccaaaatgtgttgcgagaaaatatcagtgatgcgatgactggactctataatcgcaaaattttaacccctgaactggagcagcggttgcagaaactggtgcaatccggttcttcggtgatgtttattgctattgacatggacaagttaaagcaaataaatgacaccctcggtcatcaggagggggatttagcgattacgttattagctcaggcgattaaacagtcgattcgtaaaagtgattatgccatccgactcggtggcgatgaattctgcatcattcttgtcgattcgacgccgcaaattgcagcacaactgcctgaacgtatcgaaaaacgtctgcaacatatcgcgccgcagaaagagatcggcttctcttccggtatttacgcgatgaaagaaaacgatacgttacatgatgcgtataaagcttccgatgagcgtttatatgtcaataagcagaacaaaaacagccgttcatgataatcttctgtggttgtttgcttgtaatctcaggagcatgaaatgactgaaatggctaaaggaagcgtgacgcatcagcggttaatcgctttattatcacaagaaggtgctaacttccgcgtcgttacccatgaagcggtaggtaaatgtgaagcggtgtcagaaattcgtggcaccgctttaggccagggggctaaggcactggtatgcaaagtcaaaggcaatggcgtaaatcaacatgttctggcgatcctcgctgccgatcaacaggccgatctgagccaactcgccagccatataggcggattacgcgcttcgttggccagcccggcggaagtcgatgaactcacaggctgtgtcttcggcgcgatcccccctttcagcttccatccaaaactcaaactggttgccgaccccctactcttcgaacgatttgatgaaatcgccttcaatgcaggcatgctggataaatccgttattttgaaaaccgcggattatttgcgtattgcgcaaccagaactggtcaatttccgccgcactgcgtaactagcctgtccgttcaataagcagaacggacaaaaccagcacagcagcaatggcaaaaaacgatgacgtgataatcagtgtctcgacgaacatttgatcgttcatagtatgcccccgggagatagctgttttcacgttattgttagcgtgcacaaatggcagtttgatgacagttcgcctgattttttatgcagaaaacgtaaagattttctacttcctgcctgcagcaagcgtaaagtaagcaggcttattattttttggcaaggaaaccacgatgtttgatgtcactttgctgatcctgctcgggttagctgcgctgggctttatcagtcataacaccactgtcgccgtttcaattctggtgttgatcattgtccgcgtcacaccgttaagcacctttttcccgtggattgaaaaacaggggctaagtatcgggataatcattctgacgattggcgttatggctcccatcgccagcgggacgctaccgccctcaaccctgattcactcgtttctgaactggaaatcgctggtggcaattgcagtcggcgttattgtctcctggctgggggggcgcggcgtgacgttaatgggcagccagccgcaactggtcgccgggctgctggtgggcactgttttaggcgtggcgctgtttcgcggcgtaccggttggcccgcttattgccgcgggtctggtttcgctgattgtggggaaacagtagttaatcccgcaatatatcggcctggcgtttgccccaggcctttcttaaacatagtaataaaggccgttgttgaatcataccccagcgtatgagcaactttctgtacagtatcgcctttcactaatccctgaagcgccataatcagctgtaactgctgacgccactggcgaaaactcaaccccgtctctttcactatcagccgggcaagattgcgttcactcatcgcaaaaaagccagcccattgccccaatgagccccactcgacgggctctttcgccatcatctccaccatcgtgcggattttaagatgagaagaaacgggcaggtgcagctgttgttgtggctgctgagggagttcatcaaacaggacctgaattaatctgcgggtcatcggctcagcacgctgagtcgtcgtcctgtttgccagggttaaaattaattcccggcataagggcgatattttcaatgtgcaacatgttgtcggcattgtcactgcgctgggctcgataaacagaaaacagagttcagcgttagctgtcacttgattgctatgtttcaccccgcccggtatccaaaccgcatattgtggcggcaccatccacaaagcattttccaccgtacaggtaattgcaccatgtagtgccagtatcaactgccctttgcggtgctgatgtacaggactggttaactcatccgttccggcgtgaatacaaaatgcgaccgcggcttcatggtgtcggtcgggttcatagccattgagattcaacctgtgcatcattttgtccgaatttagcgatattttgtcattttagcttgattcaacataacaataaaaacggtaaggtacagcctcgtttgtaacaatgagaagcatatgacctgttcaacttcattaagcggcaaaaacaggattgtccttatcgctggcattctgatgattgccacaacattacgcgtcacctttaccggcgcagcaccgttactggatacgattcgttccgcttactcgctaacgacggcgcaaaccggcttattgagcaccctgccattattagcctttgcgctaatctcaccgctggccgccccggtggcgcgacgttttggtatggaacgtagcctgtttgccgcgttacttttgatctgtgcaggtatcgcaattcgctctctcccttcgccttacttattatttggcggtacagcggtcattggcggtgggattgcattaggcaatgtcttactgccaggattaattaaacgcgatttccctcattccgtcgccagacttaccggcgcatattccctgacaatgggagctgcggcggcactgggatcggcgatggtagtgccgctggctttgaacggttttggctggcaaggcgcgttgctcatgctgatgtgttttcctctgctggctctttttttatggctgccacagtggcgaagtcaacaacatgcaaatttgagtacctcacgcgccttacatactcggggtatctggcgttcgccgcttgcctggcaggtaacattgtttcttgggatcaactcactggtctattacgtgattattggctggcttccggcgattctcatcagtcacggctatagcgaagcacaggcgggttcactgcatggtttgctgcaactagccacagcaactcccggtttgctgatcccacttttcttacatcatgtgaaagatcagcgtggtattgcagcgttcgttgccttgatgtgcgcagtgggcgcggttgggctctgctttatgccagcacacgcgatcacctggactctgcttttcggttttggttccggcgcaacaatgatactggggttgacgttcattggtctgcgggcaagttctgcgcatcaggcggcggcactctcggggatggcacaatccgtcgggtatttgctggcagcctgtgggccgccgctgatgggtaaaatacacgatgctaacggtgactggtccgtaccactgatgggtgttgcaatactttcactactgatggcgattttcggactttgcgccgggagagacaaagaaattcgctaatatccggtgctatagtgacgtgacaaatcatgcgtgaaagggagaacaaatacgatgaatattcagtgcaaacgcgtttatgatccggctgaacagagcgatggttatcgcgtactggtcgaccgcctctggccacgcggtatcaaaaaaaccgatttagcccttgatgaatgggataaagaaatcacgccgtcaacggagctgcgcaaagcctttcacggcgaagtcgtcgattttgcaacctttcgcgagcaatatcttgcagaactggcgcaacacgagcaagaaggaaagcggctggcagacatcgccaaaaaacagccgctgaccctgctctactcagcaaaaaacaccacgcagaaccatgcgctggtgctggcagactggctacgtagcttgtgattttagtacagcatccggcggttatttttcaccagccggatggtcccgtcgccacaatgcccattcatcaatcgtttcaccgcccggtaatttgcaattgttgctgaccccttgcgctgtctgcacaggaatgagcgtcccgcccttctgctggcaatagaccgacgccggatttgccataccaatctgcggcggtttaggtgcttctggctgagaaggggttgaacaaccagccaggaccagcaagcaaggcagaacaaaactgataattttcatttattgatctcacatatttatccaagcttagagtatcgcggtatcgttttgttttgcagcactatttttattacattcactcaaaacatattacgccttgtttcatctttgttgatgatgttttatcatgcctgcaaagattaaataatcagcatttacccgccgtatcctggagttgtttcgtgtcagatcagattatcgcccgcgtctcgcaatcccttgccaaagaacagtcactggaaagtctggttcgacagcttctggagatgctggaaatggtcactgatatggagtcaacctacctgaccaaagtggatgtcgaagcgcgcctgcagcatataatgtttgcccgtaatagccagaaaatgcacatcccggagaattttaccgtctcgtgggattactcgttatgcaaacgcgccattgatgaaaactgttttttcagcgatgaagtccccgaccgttggggcgactgtgttgcggcacgcaatcttggcatcaccacatttctgagcacgccaattcacttaccggatggatcattctatggcacgctttgcgccgccagcagtgagaagcgccagtggagtgaacgcgcggaacaggtcttacagttgttcgccggactgattgcacaatatattcaaaaagaggcactggttgaacagctgcgcgaagctaatgctgcgctgattgcgcaatcgtataccgactcgttaaccgggctaccgaatcggcgggcgatttttgaaaatctgacgacgctgttttctctcgcccggcatcttaaccataagataatgatcgcgtttatcgatctggataacttcaaattaatcaatgatcgttttggtcataatagtggcgatctgtttctcattcaggttggcgagcgccttaatacgctccagcaaaatggcgaagttattggtcgtctcggcggtgatgagtttttggttgtttcactgaacaacgagaatgcggatatttcgtcgctgcgagaacgtattcaacaacaaatacgcggagaatatcacttaggtgatgttgatttgtattatcctggtgccagtcttggcatagtagaagtcgatcctgaaacgaccgatgcagacagtgccctgcatgctgccgatatcgcgatgtatcaggagaaaaaacataaacagaaaacaccttttgtcacgcattcagcgctacattcctgaggcgtattcacatccttttgattggtgataacatgcgaatcggtattatttttccggttgtaatctttattacagcggtcgtatttttagcatggttttttattggcggctatgctgccccgggagcataaagatgaaaaaaacaacgattattatgatgggtgtggcgattattgtcgtactcggcactgagctgggatggtggtaacgtcacatctaaaaaatagcaaaggctgcctgtgtgcagcctttgtgcaatttacgcgttaacttttaatcttcctgtagataaatagcacaacaatcgcaccaataacggcaaccacgaagctgccaaaattgaagccatcgactttaccaaagccaaacagcgtgctgatccatccgccgactacggcaccgactatccccagcaggatagtcataaagaatccaccaccatctttacctggcatgatccacttcgccagaataccggcaataagcccaaaaataatccatgacagaatgcccattgtttcctcacttatctgttttgcattagcgggttagtcgctgataaaaagcatagcacaacatcgggagggtaagatttgtgacgagcatcacggaggaattttttgcgatggcgcagaaattgcgccatcaacgatcagtgataattaccaaccacaaacatcatgttcgttttccgtgtcataagaacgcacggtattcaccagatcttttatcacttcagccgccacttctggcaccagcaaagtcatcggcgtctctgtttcataatcgacagaaacgccattgctgttattggtgacggtcacggtatacgttgctttgcccatgattcatttcccgttatgaatgactttccgttgttgcgcgccttccatcaggacttcaggagcaacgaagaagtcaatgttgaaataagtatcgtcagtcatggcttcaatgttgtgccacttttctggagggaacaccgcaaactgccccgcttcgataaggatcacctgatcaggctctgcactgtgttcatcagcgtagccgagatatttgaccgccccatgcataacggaaaggcgtgggtaaacccccgggcgcgttcctttatcaagatgacgttcgaatattccggcaggcgcagtttgtttattccagaaaggcgttgagcgcgtatgaatataattctgtgggatttgcagcatccttttccctccttcggtgaatgcgctgaaaacggtttattccagccgtttcagggtacgcctgataatttgcattttaaataccatttattggttactttttagcaccggatcagagaagaatcagggaggattacaggtgggaagcccgcggcaacgcgggctgaaagcatcaggattgcagcgtcgccagtcgggcggcgaaacccacgaacatcaaaccaatcagtgagttgcccactttagccagtttctttttggtacgtatgtactgcgtgacaaaagccccagaaataatcaggaagctcaaatagcagaaactcaccagttccagcgtcgtcgccagaataaagaatgaaattcccgtatgtggggcattaacatcgataaactgtacgaaaaacgacacatagaacaaaatggctttcggattagtcaggctcaaaattaacgcgcgtttaaaaatggcaccgtattggggctcatcggatttggtctcgctatttttacctttcagggtcgcgtagagaattttactccccagatagagcaaataaaacgcaccaagataacgtacgatgttgaataatatcggggtggtcttaattaatgtcgccactccagcccatgccagaaacatcaataccgcatcgccaataaatacaccacaggccgcaagataaccgcctttcataccgctactgacgctatttttgagtacaaacagggtatttggccctggcaccaacacaataaaaatggccccaaccagataggtccagtaattcagaaccccgtattcagcgaacacattaacctctttaattatctttcgatcatgcgcgattaaaggtgaatatgctaaccaatctgtagcggcttagaaaggagaaaatcaggttttaacccgatatcaacccgataattgaatcattaatcaggcctgctccagtgaaaaattcgggtagtgctcggcaaaatactggcgtaaaaattctaccgttatccgcactttcgctgacgtcgacagctttgaaacataaacggcccagacattcgctggctggtaatattccggtagcacttgtactaaatgaccactggcgggaaacagcctggcgacatcgatttttacgtggtccggaaaaacaccgaaggcgaatattcctcgccaggcggtagagtaaatgaaggaacagagaatgaagtcgtcattcaggaatcggtatttactcgtcgtggtgtcgagcgcattttgcgttaagctcaaataagttcatttgaaccgcctgctgttggatttgtagtttgccgaagccggactgagcgcgcccagtccggcttcggaagattttactgtggatattcctgcaataaattgtgtaatgcttccgccatcagctcaccacgccagccggaaatcagctccggcaaattgttctgcggtttcagtttccagtgccagttcagcagttggttgatttgccgacgcgatgccagcaattcggcgctgatcttgtgcgtttcgctgacgtcagtaatcagcgacttaatcgctttaaacgctttacgataacccggcatgtccatcaggttaagcatcggctgcggtaaggcctcttccggcaatgcctgcgctttttccaccagcgccagcaacgttttaccgtggaagcggatttcgctaccggataagcccaggctgtccagttcgcccagacttcccggcatataacgcgctaccgaccacaaatgctcttcacgcacgacaaagttcaccgccagatcgcgctctcgcgccttgcgcaatcgccagtcggctaacagttgcagacaggccagttggcgtgtgcgtaattgccaggcattggtgatatcacgccaggcgtcttccggcgcaacgacttcctgacgacgcatttgcatcaggcggcattcatccagcgccgcaggtagccagccggaggcctccgtttctaccataagctttgcggtgatcggtaacagataccagacatccgccgctgcgtattcacactgacgttcggtcagcggtctggccagccagtcggtgcgcgattcactcttgtccagcgtaacgccggaatactcttccaccatggaagcgaaaccccatgacatcgggcgtccgcagaaggcagcaaggatttgcgtgtcaatcaagggttgtggtaattcgccaaagacattgaggaacacttccagatcttcactgcctgcatgaagaaattttgtgatggacggatcgcgcaggatcgctttcagcggtgaccagtcggtgatcccgagaggatcaattagcgccagatgctcaccatcaaaaagttgaattaaacccagctgcgggtaataagtgcgcgtacgaacaaattcagtatccagggctatcgccggaaaggcacggacggcttcacacaaagaagccagcgcatcgtccgtggtaatcatttggtaattcaaattgtattctctttagtgggcgtcaaaaaaaacgccggattaaccggcgtctgacgactgacttaacgctcaggctttattgtccactttgccgcgcgcttcgtcacgtaattctcgtcgcaaaatttttccgacgttagatttcggtaactcatcacgaaactccaccagcttcggtactttgtagcccgtgagctgacggcggcaaaaagtcaccagtgactcttcggtaagcgatggatcttttttcactacgaagattttcaccgcttcaccactggagccagaaggtacgccaacagccgcgacttcctgtacgccaggatgctgcatgacgacatcttcaatctcgttgggatagacgttaaaaccggaaaccagaatcatgtcttttttgcgatcgacaatgcgcaggaatccttcttcatccatcaccgcgatgtcgccggtgtgtaaccagccatttttgatgatttcatcggtagcatccggacgctgccagtaacccagcatcacctgcggtcctttgacacaaagctcacctggttgacccggtggtacttcattatcatcatcatccaccagtttggcttccgtcgacggcaccggtaaaccgatgctaccactatgataatcaatatcatacgggttaacgctgaccagcggcgcacactcggtcaggccataaccttccagcagatactgtccagtcagtttcacccaacgttctgccaccacttgctgaacaggcatccctccgcctgcggaaagatgcagactggagaaatccagctgctggaactctttattgttcagcaacgcattgaacaaggtgttaacgccagtgatagcggtaaacggatatttcgctaactcttttaccaaccctggaatatcgcgcgggttagtgataagcaggttctgcccacccagttcgataaacagcaggcagttaatggtcagggcaaaaatgtgatacagcggcagcgccgtcaccaccagctctttgcccggatgcaacagcggaccataggtcgcgttaacctgttccaggttcgccagcatattgcggtgagtcagcatcgcgcctttcgccacaccagtggtgccgccggtgtattgcaggaaagctaaatcttccggcaccagttctggtttgacatactgcatccggtagccgttgtgcagggcgctacgaaatgaaatggcatctggcagatggtatttcggcaccagacgcttgatgtatttaacaacgaaattgactaccgtgccttttgccgtagatagctgatcgcccatacgggtcagaataacgtgctgaacggcggttttatcaaccactttttccagagtgtgggcaaagttagacacgataacaatcgccgatgcgccgctatcgttaagctgatgctcaagctcacgcggggtatacaacgggttaacgtttacgacgatcatcccggcacgcaaaatgccaaacagcgccaccggatattgcaataagttaggcatcatcaacgcaacgcgatcgcctttcttcagccccaacccttgttgcaaataagcggcaaacgcgcgactgcgttcttccagtttgcggaaggtcatcacctcccccatattcacaaacgcgggttgatcggcgtagcgcgcgaccgactgctcaaacatatctaccagagattgataacggtcagggttgatctccgtcggaacgtccgcgggataacggttaagccaaaccttcttcaattcttcacctctaaaatgcgtgttcgtcgtcatcgcaaccccaagcaataaacatatcattaacataatattaactcatcataccagcttgataattacccaacgaaaaggttgcgaagcgcgtcactatttatttttatctttaccgtaagaatgcagaaacagcggaccggccgctgtttctttttctttaaaaacaagcaattattcagttacaactgtttgtactctcgcggggccgggattataccagccccatccgccgtagccatagggccagccacgaccgccataaaaccatggatcaatcggctgaggcggcataatcacctgctgggttaaatgccaacgtttgtaacccgttacttgcatcaccataaatttatagggcgtattaccgattttgccgtcaaccgcaccggtgattggcccgactaccgtcaccagttgtccgcggaaatccaccgggtccagaaaaccgttcacatcggcataaatgcgaccgcgagaaggttctcccagcatcggtctggctccgctgtccagtggtacggtggcaatttccaggcgggttttcccttgctggttttgtaccgcaaccactttgccgccaaagcgtgcctcctgaccaacgtacagctgcggcgcactcataacccgaactaaatcttgttgcggcgtgggactgctgcctttaatggcgtccggcacagtgacacaaccgctcagcattagcgcaaacgtacctgccagtatgcctttgataacattcttttgaaccgccatgatgcgactcctttttttctcagggcatactcttaagattcattctttgcccggaagtttcttccatgcgacgttgttacgtaaataaactggttcagcatgttccaccgccaccgttttaccctcggcaaacatctggcacgcaatcggcagcatatcttctgcagcgggcagtaacacttcgccatcgagcaaaaccagcccgctctctttaccgagatccggccaggcttgccagcccgtccctactgtcacccattcgccggaaagctgttgcattcgttcatgaacgagttcgggtttgagtacggcttcggtttcttcaccgtgccagataccgttttcatcacgctgatattcggcccagtaaacttcgcccattcgcgcgtcaatagctgccagcacgcgggttgcgccgtttttgcgccacgccccttgcgccatcgtcattagcgtggagacgccaatcattggtaactccgcgccaagtgccagtccttgcgcaatgccaataccaatgcgcacgccggtgaagctaccggggccgcgcccgtaagccagagcgtttatgtcagtcagggaagttccgctggtggtcaggatatcctgcaccatcggtaagattcgttgagtatgttcacgagggcaaagctcaaaatgagcgttgacagtaccgtcgttccacagggcgacagagcaggcctctgtcgcggtatcgatagccagaattcgcatgggtcttcgtgcttagatcaataaaaaggcgcgcatcataccatactccgtaacaaattacctggaggatggtatcgcaaggaaacgaaccgcacgggcaatgtcacgggtgcgcggcgctggcggcagactggcgagaaacgtcgcgccgtaagggcgcatcaccagccgattgtcgcaaatcactaacacgccgcgatcgtcggcgtcgcgaatcaatcgccctaccccctgcttgagagtaatgaccgcatccggcagttgtacttcatcgaacggatcaccactgcgcaaacggcaatcttccatgcgtgcttttaatagtggatcatccggcgaggtaaacggcaatttgtcgataatcaccaatgacaatgtatcgccacgcacgtccaccccttcccagaaactgctggttgccacaagaagcgcgttaccggcgctgacaaattgctgcaacagttgccctttgctggtttccccctgcaacaaaacgggaagcgtcatggtagcgcggaactgctcggccagatcgcgcatcatggcgtgcgaggtacaaagcataaaacaacgaccgttgttagcttcgatgatcggtcgcagcattgccgccagttgccgtgcggaacccggttgattagtttgcggcaggttgcgcggcacacagagtaacgcctggcggctgtaatcaaaggggctgggtaacagcaacgactctgccagttcaatgccaagccgcgaggtgaaatgatgcagatcgtcgttcaccgacagcgttgctgaggtaaagatccagctaccgggtttttgcgccattaactctttgaatttatccgccacgctgagcggcgtgagagccagagtaaaatggcgcgaagtgcattcgtaccagtagctgtagcccggctgattgatctcttttagccgtttcagccgtgtgcgatataacgtggcgcgttcaaatgccgcatccagcaaggcggaacgccccagcgacagtttcgccacgtcataacaaagttccagagtgtcatcgagcagtaaaaatgcccgctgaatttgcggattagctaacagctcacgcaggttaccgcgataacctggctcaccgagttgcaggcgaaaatcctgcgcactctgggcaagacggtcagcgcacttttgtaactgctgggtgtcttttaattcggtgcggtaggcgatggtgatgtcttttgccaggtcgagcagttgtcgactggagagtgactgaccaaaatactggctggcaatgtcgggcagctggtgggcttcgtcgaagatcatgacgtcagcttccgggatcagttcgccaaatccactctctttcaccaccatatccgccagaaagagatgatggtttaccaccaccacatcggcgtccatcgcttttttgcgtgctttgactacaaagcaatctttatacatcgggcagtcgctgccaaggcagttatcgttggtgctggtgaccagcggccacgcctgtgaatcttccgccacgctgacgcaggtgctgatatcaccatcgactgtttgattagaccaggagcgcagcaggatcacatcgcttaatatttgtaccggcagatcgccgcccgctagcgcctgttgttcgagacgttcgaggcagaggtagtttgagcgccctttcagcaacgccacgttgcccgtatatttcaacgcctttgaaaccgttggcaaatcgcggctgtagagctgatcctgcaacgcttttgaaccggtcgagataatgactttctttttcgcccgcagcgcaggggccaggtaagcgtaggttttgcccgtaccggttccggcttccaccaccagcggctggcctttttctatcgcctgggtgacggctaccgccatctgtcgctgtggttctcgcggcttaaagcctggtatcgctttcgccaactgaccgtctggtgcaaaatcgtccgtcacactaccccctgttgatttgaacagggattatgtcaggatgagggcgctttcgccagttgaagtggtgacggcgacctcacattgtggcagtctttgcagcacgaaaatggaaggataatgaggacaaaatgatgactatcgttcgtatcgatgctgaagcccgctggtctgatgtggtgatccacaacaacacgctctactacactggtgtaccggaaaacctcgacgccgatgcttttgaccaaaccgccaacacgctggcgcagattgacgccgtgctggaaaaacagggcagcaataaatcgagcattctggatgccaccattttcctggctgataaaaacgacttcgcggcgatgaataaagcgtgggatgcctgggttgtcgcgggtcatgcgccggtgcgctgcacggtacaagcgggtttgatgaacccgaagtataaagttgaaattaagattgtggctgcggtgtaagctttatcgaagcaaaataagtcagacgataatttatcgataatactggtcggttttacataaatcgaccagagattaagatattactgttgatgctcctgctaattcattatttatttttataatttcaattttagctataaaactaactatataaataaacataacaatgccgttgtgttcgcccttcgattagcgtctctggttttctttcttagctgaacaatttggttatagcgtgagaactgaccgttaattttctccctcttactggataacacaccatgagctgctacctttaaaacacctgaatgtcaacaggttaactcgtgccatatcgttataatccctttgatattagatgcaaattaaggtcatatatagccttatcgataacatggttaattttaaggataagaatatgcctgctgtaatagataaagccctggatttcattggtgccatggatgtatcagcaccaacaccaagttcgatgaatgaaagtacggcgaagggaatctttaaatatttaaaagaactgggagtacccgcgagtgccgctgatattacgacgcgagctgacctggaaggctggaacccggggttcacggaaaaaatggttggatgggcaaaaaaaatggagtctggtgaacgcattgtgattaaaaatcctgaatacttttcaacatatatgcaggaagaactaaaagcactggtctaagttaaatttacatcagcataaatgggtcaggacgcttttaatcacatatgaaaagcgtcctttttctcacaatcaaataaccatcggcttctataacgaaagcgatacggataagtgtgttactcgtcttcatcctcaaaacgcgccacgattcgctcgccggaatggttggcacgcagctcttctgccaccagcgcgattgcctggccgctgctcatcccttgagccatcagttcctggatccgctcgacagctttttgctgctgttcatgggtgagtgaaggtaaacctgcaaacattgttaactcctgctaaattgttggcgctaattatttcatgctacccggcacatagccagtagagtcaggactgatgaagacgttatctcccgctgtgattactttaccctggcgtcaggacgccgctgaattttatttctcacgcttaagccacctgccgtgggcgatgcttttacactccggctatgccgatcatccatatagccgctttgatattgtggtcgccgagccgatttgcactttaaccactttcggtaaagaaaccgttgttagtgaaagcgaaaaacgcacaacgaccactgatgacccgctacaggtgctccagcaggtgctggatcgcgcagacattcgcccagcgcataacgaagatttgccatttcagggcggcgcgctggggttgtttggctacgatctgggccgccgttttgagtcactgccagaaattgcgcagcaagatatcgttctgccggatatggcagtgggtatctacgactgggcgctggttgtcgaccaccagcgtcaaacagtttctttgctgagtcataatgatgtcaatgcccgtcgggcctggctggaaagccagcaattctcgccgcaggaagatttcacgctcacttccgactggcaatccaatatgacccgcgagcagtacggcgaaaaatttcgccaggtacaggaatatctgcacagcggtgattgctatcaggtgaatctcgcccagcgttttcatgcgacctattctggcgatgaatggcaggcattccttcagcttaatcaggccaaccgcgcgccgtttagcgcttttttacgccttgagcagggcgcgattttaagcctttcaccagagcggtttatcctttgtgataatagtgaaatccagacccgcccgattaaaggcacgctaccacgcctgcccgatcctcaggaagatagcaaacaagcagagaaactggcgaactcagcgaaagatcgtgccgaaaatctgatgattgtcgatttaatgcgtaatgatatcggtcgtgttgccgtagcaggttcggtaaaagtaccagagctcttcgtggtggaacccttccctgccgtgcatcatctggtcagcaccataacggcgcaactaccagaacagttacacgccagcgatctgttgcgcgcggcttttcctggtggctcaataaccggggcaccgaaagtacgggctatggaaattatcgacgaactggaaccgcaccgacgcaatgcctggtgcggcagcattggctatttgagcttttgcggcaacatggacaccagcattactatccgcacgctgactgccattaacggacaaatttactgctctgcgggcggtggaattgtcgccgatagccaggaagaagcggaatatcaggaaacttttgataaagttaataagatattacgccaactggagaagtaagacgtggaataccgtagcctgacgcttgatgattttttatcgcgctttcaacttttgcgcccgcaaattaaccgggaaaccctaaatcatcgtcaggctgccgtgttaatccccatcgtccgtcgaccgcaaccggggttgttgctgactcagcgttcgattcatctgcgtaaacacgctggacaagtggcattccctggaggcgcagtcgatgacacggacgcatcagttatcgccgctgcgctgcgcgaagctgaagaagaggtcgctataccgccttccgccgttgaggttatcggcgtgctgccgcccgtcgatagcgtcactggctatcaggtaaccccagtggtcggtattatcccgcccgatctgccgtatcgcgccagtgaagatgaagtctccgccgtctttgaaatgccgctcgcccaggcattacatctgggtcgttatcatcctttagatatctaccgccgtggcgattcacatcgggtatggctgtcctggtacgaacagtattttgtatggggaatgaccgcaggcataattcgtgagctggcgctgcaaattggtgtgaaaccctgactatacttatctttacatctacaaaacactacttgagacaatcatcgcaatattagttaaatcgcggtttttgattagtttaattcatgtgaatagttaagccagtcgccgcgttccctcttacactatgcgctgttattagttcgttactggaagtccagtcaccttgtcaggagtattatcgtgattagtctattcgacatgtttaaggtggggattggtccctcatcttcccataccgtagggcctatgaaggcgggtaaacagttcgtcgatgatctggtcgaaaaaggcttactggatagcgttactcgcgttgccgtggacgtttatggttcactgtcgctgacgggtaaaggccaccacaccgatatcgccattattatgggtcttgcaggtaacgaacctgccaccgtggatatcgacagtattcccggttttattcgcgacgtagaagagcgcgaacgtctgctgctggcacagggacggcatgaagtggatttcccgcgcgacaacgggatgcgttttcataacggtaacctgccgctgcatgaaaacggtatgcaaatccacgcctataacggcgatgaagtcgtctacagcaaaacttattattccatcggcggcggttttatcgtcgatgaagaacactttggtcaggatgctgccaacgaagtgagcgtgccgtatccgttcaaatctgccaccgaactgctcgcgtactgtaatgaaaccggcttttcgctgtctggtctcgctatgcaaaacgaactggcgctgcacagcaagaaagagatcgacgagtatttcgcgcatgtctggcaaaccatgcaggcatgtatcgatcgcgggatgaataccgaaggcgtactgccaggcccgttgcgcgtgccacgtcgtgcgtcggccctgcgccggatgctggtttccagcgataaactgtctaacgatccgatgaatgtcattgactgggtaaacatgtttgcgctggcagttaacgaagaaaacgccgccggtggccgtgtggtaactgcgccaactaacggtgcctgcggtatcgttccggcagtgctggcttactatgaccactttattgaatcagttagcccagacatctatacccgttactttatggcagcgggcgcgattggtgcactgtataaaatgaacgcgtctatttccggtgcggaagtcggttgccagggcgaagtaggtgttgcctgttcaatggctgctgcgggccttgccgagctgttgggcggtagcccggaacaggtttgtgtggcagcggaaattggcatggaacacaacctcggtctgacctgcgaccccgttgcagggcaagttcaggtgccgtgcattgaacgtaatgccattgcctctgtgaaggcgattaacgccgcacggatggctctgcgccgcaccagtgcaccgcgcgtctcgctggataaggtcatcgaaacgatgtacgaaaccggtaaggacatgaacgctaaataccgcgaaacctcacgcggtggtctggcaatcaaagtccagtgtgactaatacttcctactcgcccatctgcaacggatgggcgaatttattcccgcttcctcgtctgctgtaattttccccactacacttccactgttgcgtcaggcgtttgtcgccatacgcttacagggtggcccgcatgcaaaaagcacaacggatcattaaaacctatcgccgtaatcgaatgattgtttgtacgatttgcgcactcgttacgctcgcttcgaccctgagcgtgcgatttatttcacagcgtaacttaaatcaacaacgggtagtacaattcgccaatcacgctgtagaggaattagataaagtactgcttcccctacaggcaggtagcgaagtcttgcttccgctgattggtctgccctgctctgtcgcccatttgccattacgtaaacaggctgcaaaactccaaactgtgcgatccattggcttggtgcaagacggcacactttattgctccagcatttttggttatcgcaatgtgcccgtcgtggacattctggctgaacttcctgcaccgcaaccacttttacgactgacgaccgaccgtgccctgataaaaggcagtccggttttgattcaatggacgcctgcagcgggcagtagcaatgctggggtcatggagatgattaacatcgacttactgacggcaatgctccttgaaccacaactgccgcaaatcagtagcgccagcctgacggtggacagtcggcatttgctctatggtaatgggctggtagattcccttccgcaacctgaaaacaatgaaaactatcaggtttcttcgcaacgctttccttttaccattaacgttaatggcccaggggctacggcgctggcatggcactatcttccaacacaattaccgctggcggtgctgctaagtttactggtgggctacatcgcctggctggcgaccgcttaccgaatgagcttttcccgcgagatcaatctgggcctggcgcaacatgagttcgaattgttctgtcagcctttgcttaatgcgcgcagccagcaatgtattggtgtagagattttgctgcgctggaacaatccacgtcagggctggatttcaccggatgtgtttattcctatcgcggaagaacatcatttaattgtgccactaacccgctatgtgatggccgaaaccattcgtcagcgccatgttttcccaatgagtagtcagtttcatgttggcattaacgtcgcacccagccattttcgccgtggtgtgctgataaaagatctcaatcagtactggtttagcgctcacccgattcagcaactgatcctcgaaatcaccgaacgcgatgccttactggatgttgattaccggattgcccgcgagctgcatcgtaaaaacgtcaaactggcgattgatgacttcggcaccggcaacagttcattttcctggcttgaaacattacgtcctgacgttctgaaaattgataagtcatttaccgcagctataggttctgatgcggttaactcgacggtgaccgatatcatcatcgcactggggcaaagactgaatattgaactggtggcggagggcgtagaaacgcaagaacaggcgaagtatttgcgcagtcatggcgtgcatattttgcaagggtatttgtacgcacagccgatgccgctacgtgattttcccaaatggctggcgggcagccaaccgccgcccgcccggcataatggacatatcacacccattatgccgttacgttaacgcttactcatcttcatcgtgcgccggttgctctttaacaatgcgaaccagatcaacacgataatcattggcttcaatgatggtgatatgcagtggccctacatcaatcacatcgcccacacggggaatgtgaccatttgccgagatcacgaggcccgcgaccgtcgcgatatcatcgtcatcggcaaggtgctcaacatcaagcgcctgctgcaaggcatgcaaatctgtaccgccttttaccagccagccgtcaccgtcggtaatgatttccggcgtttcgtcagcgtccgggaattcacccgcaatggcttccagcacatccagcggcgtgaccagaccttgtaccacaccaaactcgttggtcacgataacaaagctcccgcgagcacgacgcagcacgcccagcaggttgatcggatcgagggtttccgggacgataatcgccggagacgccgaagcaatcgccgccacatcaacgccctcttccagcgccaccagcagttctttagcacgtacgatgccgataatttcatccagttcaccgcgacataccgggaacaaactgtgcggtgaggagagcagctgctcgcggatttcatcgaccccgagattagcatcaacccagcttatttcaccgcgcggcgtcatgatcccgcgcagagaacgcgacgccagcgtcagtacgccgttaatcatgtaacgttcttcttcggcaaacgcaccttccgggatcggcatcggcatcgggttatcggcatcgtgctgaacattggcctgacgtttcccgcccatcaaacgcaggatggcatcggcagtacgcgctcgcagcggcaaagtcgactggtgacgaataaagttgcgacgcgcaatctggttaaacacttcgatgatgatcgagaagccaatcgcggcatacaggtaacctttcggaatgtggaaaccgaaaccttctgccaccagactcagaccaatcattaacaggaagctcagacagagcaccaccaccgtggggtgctggttaacgaatcgcgtcagcggttttgatgccagcagcataactgccatcgcaatcactaccgccgccatcatcaccggcaaatggttaaccatccctactgcagtaattactgcatccaacgagaagacggcgtcaaggatgacaatctgtgtgacgaccacccagaaactggcgtagcctttaccgtggccggaatcatgatcgcggttttccagccgttcatgcagttcggttgttgctttgaacagcaagaatatgcccccgaacaacataatcaggtcgcgtccggagaaggagaaatccatgacggtaaatagcggtttggtcagcgtgaccatccatgaaatcagcgacagcagccccagacgcataatcagcgccagtgataatcccagcaaacgcgctttatcgcgttgttttggcggcagtttgtcagcaagaatggcgatgaagaccaggttatcgatacccagcacaatttcgagaacaacaagcgtgagtagccccgcccaaatcgaggggtccattaagaattccatgacaagctcctgcttaaggaatagctattcgacgccagaaataatgcaggcgtaacgacaaaatgcaaacgaaaggtgcggtataaagtgccagaaaggcaggcgttaaaaggcctgatgctgaaatgacgtcggtgacgatccatactgcgggctactgccctatactccatggttgttaaacaggagttaaacatatcagagacgcctctgatttggcaaagatttaccttcctttgcaaacgaatgtgacaaggatattttacctttcgaaatttctgctaatcgaaagttaaattacggatcttcatcacataaaataattttttcgatatctaaaataaatcgcgaaacgcagggggtttttggttgtagcccttatctgaatcgattcgattgtggacgacgattcaaaaacacatctggcacgttgaggtgttaacgataataaaggaggtagcaagtgaccattgctattgttataggcacacatggttgggctgcagagcagttgcttaaaacggcagaaatgctgttaggcgagcaggaaaacgtcggctggatcgatttcgttccaggtgaaaatgccgaaacgctgattgaaaagtacaacgctcagttggcaaaactcgacaccactaaaggcgtgctgtttctcgttgatacatggggaggcagcccattcaatgctgccagccgcattgtcgtcgacaaagagcattatgaagtcattgcaggcgttaacattccaatgctcgtggaaacgttaatggcccgagatgatgaccctagctttgatgaactggtggcactggcagtagaaacaggccgtgaaggcgtgaaagcactgaaagccaaacagattgaaaaagccgcgccagcacccgctgccgcagcacccaaagtggctccaactccggcaaaaccaatgggaccgaacgactacatggttattggccttgcgcgtatcgacgaccgtctgattcacggtcaggtcgccacccgctggaccaaagaaaccaatgtctcccgtattattgttgttagtgatgaagtggctgcggataccgttcgtaagacactgctcacccaggttgcacctccgggcgtaacagcacacgtagttgatgttgccaaaatgattcgcgtctacaacaacccgaaatatgctggcgaacgcgtaatgctgttatttaccaacccaacagatgtagagcgtctcgttgaaggcggcgtgaaaatcacctctgttaacgtaggtggtatggcattccgtcagggtaaaacccaggtgaataacgcggtttcggttgatgaaaaagatatcgaggcgttcaagaaactgaatgcgcgcggtattgagctggaagtccgtaaggtttccaccgatccgaaactgaaaatgatggatctgatcagcaaaatcgataagtaacgtattgtgttgattatcattcagttttcacactttagtcttacgtaaacaggagaagtacaatggagattaccactcttcaaattgtgctggtatttatcgtagcctgtatcgcaggtatgggatcaatcctcgatgaatttcagtttcaccgtccgctaatcgcgtgtaccctggtgggtatcgttcttggggatatgaaaaccggtattattatcggtggtacgctggaaatgatcgcgctgggctggatgaacatcggtgctgccgttgcgcctgacgccgccctggcttctatcatttctaccattctggttatcgcaggtcatcagagcattggtgcaggtatcgcactggcaatccctctggccgctgcaggccaggtactgaccatcatcgttcgtactattaccgttgctttccagcacgctgcggataaggcagctgataacggcaacctgacagcaatttcctggatccacgtttcttctctgttcctgcaagcaatgcgtgtggctattccggccgtcatcgttgcgctgtctgttggtaccagcgaagtacagaacatgctgaatgcgattccggaagtggtgaccaatggtctgaatatcgccggtggcatgatcgtggtggttggttatgcgatggttatcaacatgatgcgtgctggctacctgatgccgttcttctacctcggcttcgtaaccgcagcattcaccaactttaacctggttgctctgggtgtgattggtactgttatggcagtgctctacatccaacttagcccgaaatacaaccgcgtagccggtgcgcctgctcaggctgctggtaacaacgatctcgataacgaactggactaacaggtgagcgaaatggttgatacaactcaaactaccaccgagaaaaaactcactcaaagtgatattcgtggcgtcttcctgcgttctaacctctttcagggttcatggaacttcgaacgtatgcaggcactgggtttctgcttctctatggtaccggcaattcgtcgcctctaccctgagaacaacgaagctcgtaaacaagctattcgccgtcacctggagttctttaacacccagccattcgtggctgcgccgattctcggcgtaaccctggcactggaagaacagcgtgctaatggcgcagagatcgatgacggtgctatcaacggtatcaaagtcggtttgatggggccgctggctggtgtaggcgacccgatcttctggggaacggtacgtccggtatttgcagcgctgggggctggtatcgcgatgagcggcagcctgttaggtccgctgctgttcttcatcctgtttaacctggtgcgtctggcaacccgttactacggcgtagcgtatggttactccaaaggtatcgatatcgttaaagatatgggtggtggcttcctgcaaaaactgacggaaggggcgtctatcctcggcctgtttgtcatgggggcgttggttaataagtggacacatgtcaacatcccactggtggtctctcgcattactgaccagacgggcaaagaacacgttaccactgtccagactattctggaccagttaatgccaggcctggtaccactgctgctgacctttgcttgtatgtggctactgcgcaaaaaagttaacccgctgtggatcatcgttggcttcttcgtcatcggtatcgctggttacgcttgcggcctgctgggactgtaagactgttgtacactaccggggccttttggccccgtttttttatctggaggattaatgacaatcacggacctggtactgattcttttcatcgccgcacttctggccttcgcgatctacgatcagttcatcatgccccgccgtaacggccccaccctgctggcaattcctttgcttcggcgtggtcgcatcgatagcgttatcttcgtcggattgattgtcattcttatctataacaacgtcacgaatcatggcgcgctaataacaacatggttattaagtgcactggctctgatgggtttttatatattctggatccgcgttccgaagatcatctttaaacaaaaaggttttttcttcgccaatgtctggattgaatatagccgaatcaaagcgatgaacttgtcggaagatggcgtgttggtgatgcaattagaacagcgccggctgttaatccgcgttcgaaatatcgacgatctggaaaaaatttataagcttctcgtttcaactcaataagttatgaatttagccaaagctatgtttagtgtatttttaataatcagacatagctaaggctatattacctcttcccttatttgttatttattttaacgtttcattgatatataaatctaaatgaaaatcgttatcaacaaagcaataaaataatatattccaacagttgttttatattctcaaaatatgttaaggttgcgccctcatttggggagtagccaatttccagattccggaaatgtacgtgtcaacatactcgttgcaaaacgtggcacgtacggactgaacactttcagtcaggcgagaccatatgcacattaatcgctatgcctgcatgaacgcgaaaaccatcgcggcttgttgttcatgtttgcatgtttgctgggggcgatgatgtgttttatggataccccggtcaggacgttgtcatgaatatcactgctactgttcttcttgcgtttggtatgtcgatggatgcatttgctgcatcaatcggtaaaggtgccaccctccataaaccgaaattttctgaagcgttgcgaaccggccttatttttggtgctgtcgaaaccctgacgccgctgatcggctggggaatgggcatgttagccagccggtttgtccttgaatggaaccactggattgcgtttgtgctgctgatattcctcggcggacgaatgattattgagggttttcgtggcgcagatgatgaagatgaagagccgcgccgtcgacacggtttctggctactggtaaccaccgcgattgccaccagcctggatgccatggctgtgggtgttggtcttgctttcctgcaggtcaacattatcgcgaccgcattggccattggttgtgcaaccttgattatgtcgacattagggatgatggttggtcgctttatcggctcaattattgggaagaaagcggaaattctcggcgggctggtactgatcggcatcggcgtccagatcctctggacgcacttccacggttaataagaacgctgccagaggtgaatattaaagtccgtctggctgtcgaacacttcttttgctgccagtgtttgccagacttctggcttcgcacgccaggcaaacggcgtcatctgcaataatgcgacggcttcatcaccgcgaagacgcatcggataacacaactcatcactctgctgtaatgtaaaaccttccagttgttctgcatgaggtgcatgaagatgtacttcattgtaaatcagccccttcagctccattaagtgtctcggtcccggcgtagcagtaatgacccaaccgccgggcttcactactcgcactaattcttctgctttacacggcgcgtaaatacgtattatggcgtccatactggtatcggaaaacggcaaacggtggctggaagcgacacaaaaagtgacctgcggatagcgtttcgccgccgcttttatcgctaccttcgagacatccaggccaaacgtggtgatttcgggcaacgcatcagcaaatgcgtgtgtgtaatacccttcaccacagccaatatccagcaccgccgcggccttttcatcaagccgttcccgcagttggccgacaattgcatcacgcagcggctgataatgtccggcatctaagaatgcgcggcgtgcttgcatcatttccgcgctgtcgcccggatcacgtgaccgtttatgctgaacgggcagcagattgacatacccttctttcgccatatcaaactgatgtcgctggggacagatatagctgtttttttcacgcgaaagaggctgatggcaaagtggacaggaaaacgacatgacaactccggcaggatactaaaggccgcaagtgtaacgcgaatcatgcggcgggcaaatatccgaacgactggagcgaagataaaacaaagtaaaaagcctcgcattcgacgaggctttatagcgagattgaagcgtattcacacttcagatcagtggattcgatcagatagctgttacgttaacagctgccggacctttctgaccgtcctgaatttcgaactcaacgttctgaccttcagccagagttttgaaaccattaccctggatagcggagaagtgtacgaacacatctttgctgccatcagccggagtaatgaagccaaaacctttagactcgttgaaccacttaacctgacctttaatctttgccatttgaaaaattccttagattgttttcttcgcccgcaggcataacatagataaaactgacacattactgcatgaggcaccaatataaggctcggcagagaagcggtattcaacgtcaacgtgtttactcaggacttctttactgaaaatgccacacataaacagaactgtacctcgtttaacccgaaatctgttatcacatacaacgttaattatggcaagccatttttaaacatgtctcgatcagacgcacaaatctcgatacgtcttccactttttttgcacacttatgcaacggaatacgcgccgatatatcattgtgcttaaccttgccagttcaggcagatacttaaactggcgtattttctaacatagttcaataagttcagttgttccaggccagtgggagaagttattacatagtgcgtgcaatatcacattttttgctatgcaatgaataaaaagttatatcactttttctcataaaacagtcagttaacggctatcaattaccctaaagagaagtcagtccccaaagggattgtaaatttaaaataagaaaaattgatgaatgagcaaaaaaatcaagagagaaacgtttcgctaataaataataccacacttaatcacaaatccgatgtaaacatcctaataaattaatgagggaaatatctttttctgatatcccgttacgcaaattaataatatgataattatttgaagtcagaccagagttttaatttgaagcagctgcaccatgacagtgcgtataatcagcatgaattgagtaacccttcaacgacggggttactcaagattgaagaaggattatcgttcggcgaccagacgaataatatcttcgtcttcaaccgatttttgactctcaacggtctttttatctgctttctcaggttcgtttgcttcgcacaaacgacgtaacagtgcattttgacgtttttgctgatccagcaacgcctcaagcagttcaatctgttcgttagtccgtgaactggcacgattgataaaaaaccacaagatgagcccgataagaagaaccaccaccgatacaaccaaagacgcaatgttcatcacgcctgaatttacaacttcgttcatttcaccacctctgagtagaggcgctattctaccactgctggagaggaagaaaatctagtgctgaaaaaatgatatcaccacgggataaactggttaatggcacaaattccgctgaaaaattgtacatcctgatcgcacatcatgttgaatacctgcgcccaaagcagcaagcaagccaacaccacgacaaccagagcgacccatcgaaactttttcactccaatctccgtttcacctaccttatgtcattaaactagcatgcgttagttaaacagcgcctaactatgtcgatattcgtgctttttcggaatgagtcgcttgcttcagcgcatattgccgctacgattaagcgaacataaaaagagaagaggttgtaatgcgattcatcattcgcacagttatgctgatagcgctggtatggataggattattactcagcggatatggcgttttgattggaagcaaagagaatgccgcgggattaggtttacaatgtacctatctgaccgccagaggcaccagcacggtacaatacctgcacactaaaagtggttttctggggataacagattgcccgttgttacgtaaaagcaatattgtggtcgataatggttaaggataataaataaccagattctcactcatgagtaaaatattcttatcgcaagtgcgtttaatataacgccaccttcaactttatttttctcatgctaaataaagaacctgtctgtttgatattcagacaggttcttactctcatcagaacggatagtcgtgataacccatttgggcagaaattttgcgcgccgcggtatgcaacattgcgacatattcctgtaaacgctcttcagagaaacgtaacgtcgggaaggagatgctcaaaccagcaatgaccacgccaaagcgatcaaataccggaaccgcaatgcatcgcagcccttcttcctgctcttcattatcttcgccatacccctgctcgcgcacctggtccagaacgggtaataacgcttctgtactggtgatggtccgctcggtactgcgtttatactccacgccctcaagaatttgcatcacttcatcgcgatcgcgccatgccagcagtaccttaccaatcgcggtgctgtacagcggattacgacgcccaatccgtgaatacatgcgcaaattgtacattgagtcaattttgtggatgtaaacaatactgtcttcgtccagtgcgccgaggtggatagtttctttggtcaggcgggagatctcacgcatctggatatctgcgctacgaattaaatcgacgttttgcaacgcgcgagcgcccagttcgaacaatttcagggtcagcgaatatttctccgactccccttcctgcgccacataacctaaagttttcatggtctgtaaaaagcgataaacggtgctttttgacatcatgacgcgctgcgacaactcggttatccctatttcgcgctcttcacccagcgcctgcaaaatgccaaaaacttttagcacggaagatacagaatcaggctgtttatccagatctgcgttagccatttatcacctcattgcgagtgttttataaaaatcagaactgttttttattataatttcgcacctgggtggtcgcaatccatcttttgccggttagttacaattctgcgacatccaccgtgaatatcagtgctagaatcatacccctgttgattattcaccaaagatataaaattcctatgccaaaagttcaggccgacggcctgccattgcccctgcgatacggtgcgatattaaccattgtgattggtatttcgatggctgtccttgacggcgcaatcgccaacgtcgccttgccaacaatcgctacggaccttcatgccacgccagccagttccatctgggtagtgaacgcctatcaaatcgccattgtcatctccctgctctcgttttcgtttctgggcgatatgtttggctatcgacgtatttataaatgcggtctggtcgtttttctgttgtcttcactgttctgcgccctttctgattcgctgcaaatgctcacccttgcgcgtgtcatacaaggtttcggcggtgcagcgttgatgagcgttaataccgcacttatccgcctgatctatccacaacgttttctgggtagagggatgggcataaactcgtttattgttgccgtctcttctgctgccgggccgacaattgctgcagcaatcctctccatcgcatcctggaaatggttatttttaatcaacgtaccgttgggtattatcgccctgcttctggcgatgcgttttctgccacccaatggttctcgcgccagtaaaccccgtttcgacctgcccagcaccgtgatgaacgcgttaaccttcggcctgcttatcactgcgttgagtggtttcgctcaggggcaatcgctgacattgattggtgcggaactggtggtaatggttgtcgttggtattttctttattcgccgccagctttctcttcccgtaccgctgctaccggtggatttactgcatatcccgctgttttcactttctatttgcacatctgtttgctctttctgcgcacaaatgctggcaatggtttccctgcccttttacctgcaaaccgtgctcgggcgtagtgaagtcgaaacaggtttacttctgacaccgtggccgttagcaacgatggtgatggctccactggcaggctatttgattgaacgcgtacatgcaggattgctgggtgctttagggttattcatcatggctgcggggcttttttccctggttctgctgccagcgtcacctacggatatcaatattatctggccgatgatcttatgtggtgctggatttggcttgttccagtcacccaataaccacaccattattacctccgctcctcgcgaacgtagcggtggagccagtggcatgttagggacagctcgtcttctgggtcagagtagcggcgcggctctggtagcgctgatgctaaatcagtttggtgataatggtacgcacgtctcgctgatagctgcggctattctggcattgattgctgcctgtgtcagtggtttacatatcactcagccacgatccagggcataaaaaaagcgcgtcgatcaggacgcgctttttagtatttacttcatattacttcaggtattcacccgtacgcagagcttcaatacgtttatccagcggcgggtgagtcatgaacaactcactgagcgatttcgacttcccgttaatacagaaagccatcatgctggttgcttcttgcggttcatagctggttttcaggcgttgcagcgcggcaatcattttctcgcgaccaaccagttttgccgaacccgcatcggcgtggaattcacgatgacgcgagaaccacatggtgataatgctcgccagaataccaaacaccagttccagaaccgttgcaaccgcaaagtagatcagcgggttgccgttgctctcttcaccttcatcacggtttccgcccataaaacccgcggcaagctgcgccagaatacgggaaataaagataacgaaggtgttcaccacgccctgaatcagcgtcatggtgaccatatcaccattggcgatgtggctgatttcgtgagcaattaccgcctcggcttcatccgggctcatgttctgcagcaaaccggtgctgacagcaaccagagaggcatcacggcgcgcaccggttgcaaaagcattgatgtccggcgcatggtagatagccacttgcggcatagcgatccccgcctgacgagcctgggttgctacagtattgaccagccaacgttccctttcgttacgcggttgctcgatcacttccccgccaacagatcgtaatgccatccatttggacatcagaagcgaaacgaaggaaccaccaaaaccgaacagcaaggccatgatcatcagcccctgaacgctgctcgactgtatccctgtcaggctcagtaccagcccgaaaacgaccattacggccaggttcgttagcaggaagagcgcgattcgcatcataattttctttttacctcagtttaacaaaacgcaatatgcgatacccacatcgtatgggttacgcgactattttcaagtctggatagtgcgtaagtcaccagaaagacacaactttacattttgtagcatctgatttacggcatcttgccgctgttaaaaaatcaggcacaatttcttgtgcctgattgatattacttgacgggagcgggttgttccgcgggtctggctttttcaagcttcgccagatcgagtgcgatattcaccgtctcatccagataaggatctggctcctggtaatctttcggtagatcatccagtttcttcaactccggtttaccttcgcgtttaaagcgttcgttcaaacgcgccagacgcgtcgcatcatcttcattattctctttctcacgcacagcgtaattcagagaaacgatattgcgcttgtccttcatagcgttgaagcgcgcgatatccttcatgatgttctggaactcaggatctttcgcgatacgcgcattatgttccttcagcagctccggttcaaaggccgttaaatctcctgatttcacataagtcgcggcatcaatgctatcccacggcagcgcgttatcttcgaatttctcacccgtttccgtttcttcattacccgtcggcatgatgatgtctggcgttacgcctttacgttgcgtactgccgccgttaacgcgatagaatttctggatcgtgtactgcacagaacccagcgctggccattcaggacgtaacatctgatcgtaaatacggttcaatgaacggtactgctgaacggtgcctttaccaaatgtcggttcacccacaaccagggcacgaccgtaatcctgcattgccgcggcaaagatttctgaagccgaagcactgaagcggtcaaccagcaccaccagcgggcctttatagaagacctgtccgtcggtgtcgctgtcttcacgaaccttgccgttgttatcgcggacctgaacaatcgggccggatggaatgaacagaccggagagcgatacggcttcagtcaacgccccaccaccattgctacgcaggtcgataatcacactgctgacattctgtttttccagtttctgcagttgcactttgacatcgtctgtcaaacccacatagaagcccggaatatccagcacgccgactttctctttaccgacggtcttcaccgacattttaaccgcgcggtcttcgagacgaatacgttcacgggtcaacgttaccgtacgggtcttggtccctttaccagcaggtaaaatttccagacgaaccttactgcccttaggccctttaattaaggccaccacatcatcaagacgccagccaatcacgtcaaccatcggcttgcctgtttgaccaacaccgacaattttgtcaccaacgctgatagctttgctcttcgctgccggacctcctgccaccatcgaattgataacggtgtagtcatcatccatttgcagcactgcgccaataccttccagcgacaaactcatttcagtgttgaactgttcggtattacgcggggaaagatagttggtatgcgggtcgatttcacgcgcaaacgccgtcattgccagcgagaaaacatcttcgctgttggtttgcgccagacgacgaatggcaaatttgtagcggcgagtcagggtttcacgaatttccttatccgtttttcctgtcagcttcaggattaactcgtcgaatttgactttactgtcccacagcgcgttcaactcagcctcgtttttcggccagggcgctttgctgcggtcaaggttataagtgtcgttgccggtgaaatccatcggcttttccagtaccgacaaagcgtactggtaacgttcaaaacggcgcttttgcgccagattgtagagatcgtagaaaacgtcgagtttacctgaacgcagttcatcgcctaactcagttttctttttcgcgaactgttcaacatcgcttgccagcagcacattgtggctgtaatcgagcagattcaggtagcggtcaaagattttggccgaaaatgcctgatcgaggtcgaactggcgataatgagaacgggtgaagcgcgacgttacgcgctcactcaccgtcgcatgctgcgtctcttcctttaataccggaatttgatcagcacgcgtgatatcttctacagcgaaggtctggcctgctattgcaagcaggccagctaacgcggtaagcctaaaaaacatgttcatgcctggcccggcctccgtttcagaacaccaggtgttctgcgcgcacaatcaaagacatacccgaattcagctggacgcggacgccgtctttggtgatttctaatacggtggcatccatcgcgttttgacccgctttcaccttcagggcttgtccgacagtcagagctgaaatgtcagaaaccggggtgtgctgttcttcgcgaggtgcttttactgtttttggcgctttctctaccggcttttgcgaacgaggtttacgttcagcgccttctttgcggcgtggcgtggtcggacgtggcttgcgttcgcggcgcggtgcgtcttctttctcaccagcagctgcggcagcttcgcgttttttcgcttgctgttcagcacgctgtgcctgaacacgcgctttcgcttcttcaagctgcttgcgagcatgctcgacatgttgctcgtccagctcaccgcatgggttgccgtcaagatcgacacgtgttgcgccgggtttaacaccgtaaagataacgccagctcgaagtgtagagacgtaaagcggatcgcaattgcgttttgctcaggttcatttccccggcaacacgatcgaccaaatcctgaaaaataccgattttcagcggacgcgcttcaccttccgcactgaaacagtggggaaaacgttcggccagaaacgcgattacttctttactgctattcaacttaggttgattttccatgaaatttcctgattacaacggacgtagccaacaagcgcaggcatgaacaggcgtcattataatgacgctatcagtaaatgctacgttatccgttgattatcctgcgacgctcgcaaagaattttttgtaatccgtcgttgcaagcactttttcaagctgtgccacaagctgacgtaagccttgctcatcctcgtctgtaaagcgaccgaagacggtactatcgatgtcgagaacaccaataatctgatttttcaccaccagtggcagaacaatttcagaattactcgccgcatcacaggcaatatgcccgtcaaacgcgtgaacatcctcgatacgctgcacttgattgcgggcaaccgcagtgccgcatacgccgcgcccaacgggtatccggacacaggcaattttgccctgaaatggtccgagcaccagtgtatcgtcctcaagcaaataaaaacctgcccagtttacgtcagtgagacgctcatataacaacgcactggtgttcgcaagcgttgccagaaaactggtttctcccgccatcagcgcgttaaagtcgcgatttaaatccgcgtaaaattctgctttgttcattatataatcacttggttgtcttacctggaactgccagcctattaaaataagcattaaatgcgttaatgctcaagatcattcccatcatgggttaagattaatgttaattcttattacatttggcacgtcatggctcttaacacaccacaaattacgccgacaaagaagataacagtgagggctatcggcgaggaactgccgcgtggtgattaccaacgttgcccgcaatgtgacatgctgtttagcctgcccgagataaattctcatcaaagtgcctattgtccgcgctgtcaggcaaaaattcgtgacgggcgcgactggtcgctaacgcgcctggcggcaatggccttcaccatgctgttgcttatgccgtttgcctggggcgaaccgctgttgcatatctggctgttaggcattcgtattgacgccaacattatgcaaggcatctggcaaatgaccaaacagggcgatgcgataacggggtcgatggtctttttctgcgttatcggtgcccccctcattctggtgacctccatagcttatttatggtttggtaaccgattgggaatgaatttacgcccggtactgctgatgcttgagcggctgaaagagtgggtgatgttggatatctacctggtcggcattggcgttgcttctataaaggtacaggattatgcccatatccaggcgggggtcggcttgttctcttttgtggcgttggtgattttaacgacggtgacgttgtcacatcttaatgtcgaagaactgtgggagcgattttatccgcagcgccccgctacgcgtagggacgagaaactccgtgtctgtcttgggtgccattttaccggctatcctgatcagcgtggtcgctgcccgcgttgccatatcccgctacgcctgcgtcgccgtcatagtctgcaaaaatgctgggcggcgctgttagcgtcaatcgttttgttgttacctgccaacctgttgcctatctctatcatttatctgaatggtggtcggcaggaagatacgattctttccggaattatgtcgctggcaagtagcaacattgcagttgcgggaatcgtgtttatcgccagtattctggtaccgtttactaaagtgatcgtcatgttcactttactgttgagtattcattttaaatgccagcaaggtttacgcacacgcattctgttactgcggatggtgacctggattggtcgctggtcgatgctcgacctgtttgtcatatctttaaccatgtcgctgattaatcgcgatcagatcctcgcttttactatgggaccggctgcgttttatttcggcgcagcggtaattttgactattcttgctgtggaatggctggacagccgcttactttgggatgcacatgagccaggaaatgcccgcttcgacgactgaagcgcagattaaaaataaacgccgtatctcacctttctggctgctgccgttcatcgcgctaatgattgctggttggctgatttgggacagttatcaggaccggggcaatactgtcaccatcgactttatgtcggcggatggtattgttccaggccgtacgcctgttcgttatcagggcgttgaagttggaacagtgcaggatatcagcctcagcgacgatcttcgtaagattgaagtcaaggtcagcatcaagtccgatatgaaagatgcgctgcgcgaagagacacagttctggctggtgacgccaaaggcctcgttggcaggtgtctccgggctggacgccctcgtcggtggtaattatatcggcatgatgccgggtaaaggtaaagagcaggatcactttgtcgcactcgacacccaaccgaaatatcggctggacaatggcgatctgatgatccacctgcaagcccccgatctcggttcactgagcagtggttcattggtctatttccgcaagatcccggtgggaaaagtctacgactatgccatcaatcccaacaagcaaggcgtggtgattgatgtcctgatcgagcggcgttttaccgatctggtgaaaaaaggtagccgtttctggaacgtttccggcgttgatgccaacgtcagtatcagtggcgcgaaggtgaaactggaaagtctggcggcactggttaacggtgcgattgccttcgattcacctgaagagtcgaaacctgccgaagcggaagatacctttggtctgtatgaagacctggcccatagccaacgtggcgtaataataaaactggaactgccagacggtgccggattaaccgccgactcgacgccgttaatgtatcaggggctggaagtcggacagctgactaaactggatttaaatcctggtggtaaagtcactggggaaatgaccgttgatcccagcgtcgtcaccctgcttcgtgaaaatacccgcatcgaattacgcaacccgaaattatcccttagcgatgccaatctcagcgccctgctgaccggaaaaacctttgagttggtgcccggcgatggcgagccacgcaaagagtttgttgttgtgccaggcgaaaaagccctgctgcaagagccggatgttctgacactgaccctgacagcaccagaaagttacggtattgatgctggtcagccgctcattcttcacggcgtgcaggtaggccaggttatcgatcgtaaactcaccagcaaaggcgtcacctttaccgtcgccatcaagcctcagcatcgcgaactggtaaaaggcgatagcaaatttgtcgtcaacagccgcgtcgacgtgaaggtggggctggatggcgttgagtttctcggtgccagcgcctcagaatggatcaatggcggaatacgtattctgccgggcgataaaggcgagatgaaagccagctatccactgtatgccaatcaggaaaaagcgctggagaacagccttagcgatttacccaccacaaccgtgagtttgagtgcagagacgctgccggatgtgcaggcaggatcggtagtgctgtaccgtaaatttgaagttggtgaagttattactgtgcgtccgcgagctaacgcgtttgatatcgatctgcatattaaaccggagtatcgcaaccttctgaccagcaacagcgtgttctgggcagaaggtggggcgaaagttcagctgaatggtagtggtctgactgtacaggcatccccgctctccagagcattaaagggggctattagcttcgataacctcagcggtgccagcgccagtcagcgtaaaggcgacaagcgtattctgtatgcttccgaaacagcggcccgtgcggttggcggacaaattacgcttcacgctttcgatgccggaaaactggcggtcgggatgccaattcgctatctcggtattgatatcgggcaaatccagacgctggatctgattaccgcacgcaatgaagtacaggcaaaggcggtgctctatccggaatatgtccagacctttgctcgcggtggtacgcgcttctcagtggtcacaccgcaaatttcggcagctggcgttgagcatcttgatactatcctccagccgtatatcaacgtcgaaccaggccggggcaatcctcgccgcgactttgaattacaagaggccaccattactgattcgcgttacctggatggcttaagcattattgttgaagcgccggaagccggttcgttaggtatcggtacacctgtgctgttccgtggtctggaagtaggtacggttaccggaatgacgctggggacattgtcagatcgcgtgatgattgcgatgcgcatcagtaaacgctatcaacacctggtgcgtaacaattcagtcttctggttggcatcgggttacagtctggactttggtctgacgggcggcgtagtgaaaaccggcacctttaaccagtttatccgtggcggcatcgccttcgccacgcctccgggtacgccactggcaccgaaagcccaggaaggcaagcacttcctgttgcaggaaagtgaaccgaaagagtggcgtgaatggggaactgcgcttcccaaataatgcccactgctccggcgtgcctgcgccggagcgtttatgctaaactgcgcgcctgtttttttgccagtggtatatgctcgtggcccaacacaccgtttatttcccggacgcctttctgacacaaatgcgcgaagcgatgccttcgacgctctcttttgatgattttcttgccgcctgtcagcgcccgttgcgccgcagcattcgcgttaatacgctgaaaacctccgttgctgatttcctgcaattaactgcaccttatggctggacgcttacgccaattccgtggtgtgaagaaggtttctggattgaacgcgacaatgaagatgcattgccgttgggtagtaccgccgagcatttaagcggcctgttttatattcaggaagccagttcaatgttgcctgttgccgccttgtttgctgacggtaatgcaccacagcgggtgatggatgtcgctgctgcaccaggttccaaaacgacgcaaattgctgcgcggatgaataacgaaggggcaatccttgccaatgagttttccgccagtcgggtaaaagtgttacatgccaatatcagccgctgtggcatcagtaatgttgcgctcacgcattttgatggccgcgtatttggtgcggcagtgccagaaatgttcgatgccattttgctggacgctccctgctccggcgaaggcgtggtgcgtaaagatcccgatgcgctaaaaaactggtcaccagaaagcaatcaggaaatcgcagcgacccaacgggaactgatcgacagcgcctttcatgcattacgtcctggcggtacgctggtttactcgacctgtaccttaaaccgggaagaaaacgaagccgtttgcctgtggctgaaagagacttatcccgacgcagtagagtttttaccgcttggcgatctcttccctggtgcaaacaaggcgctgaccgaggaaggctttttgcatgttttcccacaaatttacgactgcgaaggcttcttcgttgctcgtctgcgtaaaactcaggcgattcccgccttacccaccccaaaatacaaagtgggcaatttcccgttcagcccagtgaaagatcgcgaagccggtcaaattcgtcaggcggctgcaagtgttggcttaaactgggatgaaaacctgcgactctggcagcgtgacaaagaactgtggttgttcccggtaggcattgaagccctgatcggtaaagtccgattttctcgcctggggattaaacttgccgaaacgcacaacaaaggttatcgctggcagcatgaagccgttattgcccttgcctcccccgacaatgtgaacgcttttgaactgacaccgcaggaagcggaagagtggtatcgcgggcgcgatgtttacccgcaagccgcgccagtggcggatgatgtattggttaccttccagcatcagccgattggtttagccaaacggattggttcacgactgaaaaacagctacccgcgtgaactggtgcgcgacgggaaactttttaccggtaacgcctgacagcgcacaaaaaaagcgcactttttgactggcacattcaactgcctcaactaggctgaaaaatggtgcgatcggactggtcgtaccacaaccggcagctaaatggagagcacgaagatgaaaaccagtgtgcgcataggcgcttttgaaatcgacgacggcgaattacacggcgaatcgccgggtgatcgaacgttaaccattccttgtaaatcagaccccgatttatgtatgcaactggatgcctgggatgctgaaaccagtatccctgccctgctaaatggcgaacactctgtcctttaccgtacccgttacgatcaacaatctgatgcctggattatgcgtcttgcctgatccaaaaagaacccgtcggcatggcgggttatttgtccgggttattcccccgttgtaaaatctctcctaaacttaacggtacggcaccacacttcggggatgaaatgttcgcgctggtactttttgtttgctacctggatggcggttgtgaagacattgttgtggatatctacaacacggaacagcagtgtctttattctatgagcgatcaacggatccgccatggcggttgttttccgattgaggattttatagatggtttctggcgacctgcacaggagtacggtgatttttaattattgcaattgcacaagagtcagttctcccccaaagacagcaccggtatcaatataatgcaggttgccaatatccacgcgatggcgcaaaggtgtatgaccaaaccagaaatgatcagcacctgcaattccctgccctttttggcgttcacctaatcgcgagcggctccacaagacctgatgcaaatcgacgtccttttgccattcatagacatcatctggataatcggcatgagcaataacatgtttgccggtgcgactgtgtaattcaagaataaagggcaaatgctgacatttttccagcgccgttttcgcttgtttctgttgattatctgccagcgcaataaaccagtcgccgccatttatcaaccataaagacatctgccgggatgccagcgcatccatcgccatctgttcatgattgcctcttaccgcacgaacccaatgttgttccagtaactgcaggcaacgtaaactttgcggcccacgatcgataacgtctcccactgagataagtaaatctcgccacggatcaaaacgacaatgccataatttgcggcgcaactgctcaagacaaccgtgtatatcgcctgaaagccagatatgtcgccattgatgacccgcaattctctgataaacgggcgcaggctgtttcatcaatattttcctcccgcgctaaagatcacataatcttaacaagaatgttaaaaaacgctggactcagacagtagagtgtgtgttatggttgactataaagtcagcgaagggaatgcttctggcttttaacagataaaaagagaccgaacacgattcctgtattcggtccagggaaatggctcttgggagagagccgtgcgctaaaagttggcattaatgcaggcttagttgccttgctctttaagaatagatgacgacgccaggttttccagtttgcgtgcaaaatggtcaataaaaagcgtggtggtcatcagcttaaatgttaaaaaccgcccgttctggtgaaagaactgaggcggttttttattggaaatcaaaaggctattttaggtaattaacagagtttttcagctcgctctataaacggtgccagactcattttttcgccgggattgttaggatcatcaatctgaatcaccgaaatgggttgggctttagtcttcccactggcaacttccttttgtgcgatatcgtttaaaggatactgcacgagggtatttgggttaatgacatacaaagcattacccggtcggcaagtcagcatcacctcttcgcgattaaacgcccatttgtctttacccacttcaaaacggctgacggtaatcacctgcggtgccgccagcgcagctgcagaactggtgagtaacagaaacgccagaatactttttctcatcattttcgtaatccatcaaaaaggttcgagagtcgcaagcaggctgatgatcaccagcactaccgcacctatcgcccattcgagtttagtcatccagacaaaccagggagccgcacgatcttcatcctgcctcatgcgcggtacaagaacataacgattagccagcgcgatgaccaccataatcatcaccaggatggctttgagcaataagagttggccccagtaagtcgtaagcgtggggggaaatccggtaatcaacaatgcattaagcacgccgcttgccagtacgccgatcaccgcaaaatgcccgcaccaggaaaaacgcatcagcgcctgaatagcctggtgtcgccaacggcctttgatgagttgcatacaccagagcaccggcagtaatcccccaaaccacgccgccgcacagatcaggtgaattgcgtgattagtctgatggattttcgccgttaccccttcattcaacgtcgcatgcccgactcccgccagcagaataaattgcgcggtagtgagcataaacagcaaacgtggcatattccgcggttgcataagggcgacgatcaacgttacgagggcgagaacaatttgccataaccagacgccaccaaactgcgtttgcaaaacagccaaccaaatgtttggcgaaaatacatctgaccatcccgctcccatcaacccgccctgaacggcgagcattgcagtggcactgatcaaactccagacggcagcgtgctgttgtaaacgcagaaaacgcttcgtcagcaagcgacgaatcgttaaggtggccagccaggcaccgtacattgcgaagccaaaaaccagcatcagcgaggtgaaatggataaatcgcagcgcgatccaggtaaacgccagcatgatttatttcacactaaaggtgtaatgtcctttcgttttatgcccatccaccgaaacaacatgccagtcaacggtgtaggttccgggtttcagcgaatcggccagtggaacaatcagttgcttttggtcctgctcattccgcttcgccggtaatgttttaatattttcgttttttggccccgtgatttttgcaccactgaatcctgtttcaacgccttccgagaagtttaaagtgattgcctgcggagctgctgtcacttgtgcatttgccgcaggatactgatgcgttaaatgcgcatgtgcccagacggaaggtgtcaccaacgaagtggtcaggattgccagcgcgtagcgaagggagcgtgcagttgaagccatattatctattcctttttgtaataacttttttacagagcataaccttgtctaatgtctgagtcgaggatcatcaattccggcttgccatcaaggctcactcttagtaacttttgcccgcgaatgatgaggagattaagaatgctgaagaatctggctaaactggatcaaacagaaatggataaagtgaatgtcgatttggcggcggcaggggtggcatttaaagaacgctacaatatgccggtgatcgctgaagcggttgaacgtgaacagcctgaacatttgcgcagctggtttcgcgagcggcttatcgcccaccgtttggcttcggtcaatctgtcacgtttaccttacgagcccaaacttaaataaaacttatacatagttacactttcttacataacgcctgctaaattatgagtattttctaaaccgcacccataatttgcagtcattttgaaaaggaagtcattatgtcgttctggaaagttgcagcagcgcaatatgagccccgtaaaacctcactcaccgaacaggtagctcatcatctggagtttgtgagggccgccgccaggcaacaatgtcagctgttagtttttccatcgctttctttactggggtgtgattattcgcgacgtgcccttcctgccccacccgatctctcgctattagacccgctttgttatgccgcaacgacctggcgaatgaccatcattgccggccttcccgttgaatataacgatcgctttattcgtggaattgcggtattcgcaccgtggcgaaaaacgccagggatctaccatcagagttatggtgcatgtctgggccgtcgttccagaaccatcacggtggtcgatgaacaaccgcaaggtatggatatggacccgacctgttcactgtttacgacagggcaatgtctgggagaacccgacctgctagcgtcggcccgtcgcttacaatttttttcacatcagtactcgattgctgtgctgatggcaaatgcccgtggtaacagtgcactatgggatgaacatggtcgtctcatcgttcgcgccgatcgtggttcattattgttagtcggtcagcgttcatcacagggttggcaaggcgatatcattccattacgctaggcttttcggcctggagcatgccatgttgcgcattatcgatacagaaacctgcggtttgcagggagggatcgttgagattgcctctgttgatgtcattgacggaaaaatcgtcaatcccatgagccacctggtgcgtcccgatcgtcctattagtccacaggcgatggcgattcatcgcatcaccgaagccatggtcgccgataaaccgtggattgaagatgtgatcccgcactattacggtagtgaatggtatgtcgcgcataacgccagctttgaccgccgcgtactgcctgaaatgcccggtgagtggatttgcactatgaaactggcccgtcgtttgtggccagggatcaagtacagcaatatggcgctatataaaacacggaagctcaatgtacagacgccgccgggcctgcatcatcaccgcgcgttgtatgactgttatatcaccgccgcgttgcttatcgatattatgaacacctctggctggacggcagaacagatggccgatatcaccggacgtccatcgttgatgacgaccttcacctttggcaaataccgtggcaaagcggtttccgacgttgccgaacgcgatccgggctatctgcgctggttgtttaataacctcgacagcatgagcccggagctgcgtttaacactgaaacattatctggaaaatacttaatccgctgactgagcgggtaatgttccctgcgccagcgcgaccagaaaagcatattccatcgctacgccttcgtacgatttaaagcgaccagatttaccgccatgacctgagtccatgtcggtacagagcaataaaagatggtcatcggttttcagctcgcgcaatttagcgacccattttgccggttcccaatattgcacctgagaatcgtgtaaaccggtcgttaccagtaaatgcggataagcctgtgcggtgacgttgtcatacgggctgtagcttttcatatactcgtaatattgcggatcctgcggattcccccactcttcaaattcgccggtggtaagaggaattgattcatccagcattgttgttacaacatcaacaaacagtacctgggcgataacgccgtggaacaattccgggcgttgattaatcgcaacgcccatcaacataccccccgcactcccgcccatcgcataacagagcgaaggagagccatagcccagttttaacaatgcatcgcaggcatcaagataatcattaaacgtatttttcttcttcagaaatttaccgtcctcgtaccattgttgccccagctcaccgccgccacgaacatggacaatggcgtagacaaatccacgatccaacaaactcaagcggctaaaactgaaatcggcatcaatacttgcgccgtaagaaccgtagccatacaccagcagcgggttgtgtcctttgcgaaaatgtttgcgatgatagaccagcgaaaccggaacttcgacgccatcacgggcgactatccacaggtgttcactgcggtaattcgccgcatcaaaaccaggaacctccgtttgttttaatacacgacgctcaccggtatccatatccagttcaaacaaagtatctggtgtggtcatggacgaataaccataacgcaatcgcgcggtttcaggttctggattgtaggcaatccaggtcacataggccggatcatcaaaggcaatgccaatgacttcccgggtcttgcggttaatttgccgcaaactggttaacccgcgctgacgctcttcaaccaccagccagtcggtaaacagcgtaaacccttccagcataatgttatcacgtggcggaattaactcttcccactgttgctcatcacgcatacgggtacggtataagccaaagtttttaccgtggcggttggaacgcagataaaaccgatgctggtagtgatcaaggctgtattcgtgatctttgcggcgaggcagaaaaacaaacggctcggcatcggccatttccgcgtccagcaggcgaacttcactggtggtggcgctggccagatgaatgaccacataatgcttcgaggtcgttttatgcaggctgacgtaataggtatcgtctttttcttcgtaaatcagtttatcttgcgatgctggcgtaccgatggcgtgacgccagacctgataaggcagcagcgtcactggatgcttgcgaacatagtagaaagtccaggagtcatttgcccagacaaagctgggttcaacgttatccagcagttccgggtaccagttacctgtttccagattacgaaaacgaatgccgtactgccgtcgggaaagaaaatcttctgccagtgccataatggtgttatctggcgtaatcgccattccgcccatcgaataaaactcactatgagccgcgcgcttgttggcatcgagcaatgtttcccactcgtcccactcttcactgaacgccgattgacgctggtagatagcatattcacagcctggttcataaatatgccgatagcggtagccatttttgatgtagggcgcagaaacttctcgttgcggaatgcggtcgatgatttcctttaagatgcgatcctgcaaggcttgttgcgaggccatcacccgatgaccgtaactattttcttgttgcagatagtccaggacttccggctgagaacgcgtatcgtcccgcagccagtagtaattatcgatgcgcgtatcgccatgaagcgtcatggcgtggggaatgcgggcggcttttggtagcatgttattgttctttctggttgaaacatcttataagggtggcaaaactcaccggggatgcaagcgaaacagggtagtcattgcttagatgatgacaggtaatggcgcggatatcgactgttatgcagacagagaaaatcagcctgttcaaatggctgtgcggttctggataacccgaaatagtcaacttcaggctatccagagagcggaattactccgccaaagtacgtttttgctgttcgagatcgcgttcaatgccttcacgaacatcctgggggattttcagcgcatcacccagtgcattcaggtaactgcgttccataaaatggtcaatatcaatagccgcgcagctcaggaaatagatttccagcgcctcttcttcattgcggaccccggtagccaggcgttgtggatccagcggttgttcgattgcctgctcaatgagtacacgccccttctcttccacaccggcttctcgcaattgctggtcgattgccgcacgttctttggcatcaatatggccatcacttttagcggcaaagaccagcgcaaggatcaaacgttccgtacgctcatccagcggcgtactttgcgcgccaaactgctgttcatcctgatgcgccgcgcgaattttatctttgtatttattccacagcaccgtacccgctaccgctccgccgccaaccagtaacgcgtttgtgccatatttcgtaagaagtttacgtgctgatttatttgcgaccagcagcccagccagtccgcctaatgcgccaggcactaaaagtttgcccaatccctgatccgcagacgaggaggtagaagaacggctttgcccaagcagggattgcagttgatttaaccagttagccatatttgctcctcaataaccatttttagtgcctgtagcatagcggatgaggatgtcagaaaatgtatatcgagacaaaagatgcgcaaataagcggggcggtaggccgttattcaaagaaattcgcgccaggtaaggtgttcactgtatataaggtgataagggtattttaggtgaaagtagtttgacattttgagtggaactgtttgatgctgattgcccggttcgacgctactgcgtcttctcaggcctacgattgtgttgcgttgtagggcggacaaggcacccgcgccgtatccgccaacggtcaatcgaattatcagaagccattaacgccgctgatattccgccattcccgctttgcagtccacgctgacctggtaatgaatatcggcacttttaccacgcacggttagcggtactgaccatttatcatctttcccctgaatgtcctgcaaactgacccatgccacgggatcggcctgaccgacaattttttgatcatcagcccagcgcgccacgcgattttgttggtaatcacgttttacgctcgcggcaattccggcagcatccagaccttcacactttgggaaagtgaccgacttgctggtttcattattggcagcgaaaactgatgcgcaggcagaaaccaacaacagccctaaaaacgcccctctttttttcatgtttttctccatagcacaatgattcaggagaaagcatggtacaaattgtcaggagcgcaagttgcttcaggccgcgtgtgaggcatcttcctcttcggattcagcaccgacgacctgtggggacggtaatttgccggttttcagaatggtgctcagcacatctttttgttctgccagccatagcgaaagggcttcacgttgctcatcttccatttgcactggagaatttgtcagccaggtgtcaagcagatcggccgtatcaagcatcttgtcataagcatcggcttcctttttgctggtaaacgacattttctcttcgccctcacgaatgactacgtatttaacttcaaccgccatttgcagcctctcataataactgtgattttatacagtatatttcttttcagttgggaaatcaacatcagcaataaagacacacgcaaacgttttcgtttatactgcgcgcggaattaatcaggggatattcgttatgacgttattaggcactgcgctgcgtccggcagcaactcgcgtgatgttattaggctccggtgaactgggtaaagaagtggcaatcgagtgtcagcgtctcggcgtagaggtgattgccgtcgatcgctatgccgacgcaccagccatgcatgtcgcgcatcgctcccatgtcattaatatgcttgatggtgatgcattacgccgtgtggttgaactggaaaaaccacattatatcgtgccggagatcgaagctattgccaccgatatgctgatccaacttgaagaggaaggactgaatgttgtcccctgcgctcgcgcaacgaaattaacgatgaatcgcgagggtatccgtcgcctggcggcagaagagctgcagctgcccacttccacttatcgttttgccgatagcgaaaaccatttccgcgaagcggttgccgccattggctacccctgtattgttaaaccggtgatgagttcttccggtaaagggcagacgtttattcgttctgcagagcaacttgctcatgcatgggagtacgctcagcaaggtggtcgcgccggagcgggccgcgtaattgttgaaggcgtcgttaagtttgacttcgaaattaccctgctaaccgtcagcgcggtggatggcgtccatttctgtgcaccggtaggtcatcgccaggaagatggcgactatcgtgaatcctggcaaccacagcaaatgagcccgcttgcccttgaacgtgcgcaggagattgcccgtaaagtggtgctggcactgggcggttatgggctgtttggtgtcgagctgtttgtctgtggtgatgaggtgattttcagtgaagtctcccctcgcccgcatgacaccgggatggtgacgctaatttctcaggatctctcggagtttgccctgcatgtacgtgccttcctcggacttccggttggcgggatccgccagtatggtcctgctgcttctgccgttatcctgccgcaactgaccagtcagaatgtcacgtttgataatgtgcagaatgccgtaggcgcagatttgcagattcgtttatttggtaagccggaaattgatggcagccgtcgtctgggggtagcactggctactgcagagagtgttgttgacgccattgaacgcgcgaagcacgccgccggacaggtaaaagtacagggttaaacccggcaaaaatgcccgatcctcgatcgggcattttgacttttacagcttagcgccttctacagcttcacgcgccagcttagtaatgcggtcgtaatcgcccgcttccagcgcatctgccggaaccagccaggaaccaccgatgcacagcacgcttttcagcgccaggtagtcacggtagttagccggagaaataccacctgtcgggcagaaacggacctgagagaacggacccgcgatcgcctgcagggctttcacaccgccgttagcttcagccgggaagaatttgaactctttcaaaccgtagtccatacccagcatcagttcggaaacagtgctgatccccggaatcagaggaatagtcccttcggtagcagctttcagcagcggctcggtcagacccgggctaattgcaaactgtgcacctgcttcagtgacttctgccagctgctgtggattcagcaccgtaccggcacccacaatcgcttcaggcacttctttggcgatagcacggatagcgtcaactgcgcactcggtacgcagagtcacttccagaacgcgcaccccaccagcaaccaacgcttttgccatcggcaccgcgtgttccagtttttttaccacgataaccggtacaaccgggccggtggtcaggattgattctgcacttgttttccagtttttcatcagagttttctctcgcctgattacaaatttgtcgtcttaaaaagtgatacaggttgcgccctgttcggcaccggacagtttttcacgcaaggcgctgaataattcacgtcctgttcccacgcgtgacgcgctcaggtcaggaatgtgcggttcgcgagcagccagttccgcttcgtctaccagcagcgtcagttcgcctgtctgtccattcacacgaatgatgtccccgtcgcgcacttttgccagcagcccgccatcgtaggcctctggtgttacgtggatagctgacggcactttacctgaagcgccggagagtcgtccatcggtaactaacgcaattttgaaacaccggtccaataatacaccaagtggcggcatgagtttatgtaattctggcattccgttcgcttttggcccctgatgacggacaacaacgacacaatcgcggtccagtaaacccgcttcaaaggccggcataacgtcatgctggctttcaaaaacaaccgctggcgcttcaatcacctggttctctaccggcacggcagaggttttcataaccgctcgccccaggttaccgcttaacacttttgtcccaccatgatgagagaaaggttgttcgaaggacgcgatcacattgttgtcgagtgatttttctgccccttcccgccagtccagttcaccattattcagccatggttcaagggtataacgagacagaccaaagcctgccaccgtattgacatcttcatgcagcaggcctgctttgagcagttcacgtaccagaaccggtacgccacctgccgcctggaagtggttaatatcggccggaccgttcgggtagagacgtgccatcagcggtacaacatcagaaaggtcagagaagtcatcccagttaatctgaataccggctgcgcgcgccatcgccaccaggtgcatggtgtggttagtggagccaccggtcgccagcagtgcaacgataccgttcaccaccactttctcatcgatcatcttaccgatcggcatccattcattaccattaccggtcatgcgcgtaacctggcgcgcagctgcagcggtcaaagcatcgcgcagcggagaatccggatgaacaaaagaagagcctggcaactgcatccccataaactccaccaccatctggttggtgttggcagtaccgtagaaagtacatgttcccggcgcatgataagacgcggcttctgactccagtaatgccatgcggtccactttaccttcggcataaagctggcgaatacgcactttttctttatttggcaaaccgcttgccatcggtccagacggcacaaacaccgcaggcaaatgaccaaacgacagggctgccatggtcagacctgggacaatcttgtcgcacacaccgagaaacagagcaccatcaaacatgttatgggacagccccaccgccgcagacatcgcaatcacttcgcggcttaacagcgacaattccattccatcctgcccctgggtgacaccatcacacatcgccggaacaccgcccgcaacctgaccaaccgcattcgcttcatgcagggctttacgaatgatttccggatagtgttcataaggctggtgagcggagagcatgtcgttataggaggtgatgatggcgatattgttacgcaacatgcttttcaaagaggctttgtcttctggctggcaggcagcgaaaccgtgtgccaggttaccgcatgccaactgcgaacgatgaacggtcgaagttttcgcttgttctatccgggcgaggtaagcagagcgagtctcgcgcgaacgttcaatgattcgatttgttacgcgtaacaattgtggattcataaaggctcctgaaattgagttgtcagagcaggatgattcacaacacgtttcattcagaggattcatgactgaaacgcctgtaaccggagctcatagggcaaaaacgtttcagtcagtgtaataaaaaaagcctcgtgggtgaatccgcacgaggcctgaaagtgtaaaaattgttctacaatctgtgcaagatcatgttaccggtaaaatacccataaaggataagcgcagatattactcaaactcattccaggaacgaccgtcacgggtaatcatcgccaccgaggcaacgggtccccaggtaccggcctgatacggtttcggcgcatcattgtccatcgcccacgcctcagtaatggagtctacccatttccaggcttcttccacttcatcacgacgtacgaacagtgcctgaataccacgcatggtttccagcagcagacgttcataggcatctgccagatgcgtttgattaaaggtttctgaatagctcagatccagcttggtgatttgcaggttatgtttgtggtcaaggccaggaactttattcagtacctggatatccacgccttcatcaggttgcagacggatagtcagtttattctgcggcagatcctgccacgactctttaaacagattcagttcaggtgttttgaaatagaccacgacttcagaacatttggtcggtagacgtttaccagtacgcaggtagaatggcacaccggcccagcgccaattatcaatgtcgacgcggatcgccacgaaggtttctgtattgctgctcttgttcgcgccctcttcttccagatagcccggcacttttttgccctgagcgaagcccgcagtatattgcccgcgtacggttttttcgcgcacgttggaacggtcgatgcggcgcagagacttcagtactttcactttttcatcgcggatgctgtctgcgctcaggtcagacggcggagacatcgcaatcatgcaaagaatttgcagcaggtggttctggatcatgtcgcgcatctgaccggctttatcaaaatagccccagcgcccttcgatccccacttcttctgccacggtaatctcaacatgatcaatggtgcgattgtcccagttgttcacaaacagagagttagcaaaacgcagcgccaacaggttcagcactgtttctttaccaagatagtggtcgatacggtaaacctggcactcttcgaagtattcgccaacctgatcgttgatttcctgcgaggtcgccagcgacgtccccagcggtttctccatgactacgcgtgccggtttagcattcagttttgcctcaccaagccctttgcaaattgcgccaaaagtgctgggcggcatggcaaagtagttaatggtgatacgatttttttgatccagcatcgcgccgagacggctgaatgcagcagtgtcattgacatcaagattacaaaaatccagacgtgcactcagggtgtcccataaaccttcatcaatggtttctttcatgaaagtttcgagcgcctcgcggacaactttggtataagccgctttatcccagtcagcacgccctacgccgataatccgggtgtccgggttgagctgaccggctttttccagttgatacagggaaggcagcaatttacgacgcgcaaggtcgcctttcgcgccgaaaatgaccaggtcacaggcctgggctgtttgcgttaccgccatgtcattctccttaagttaactaacccggtacttaagccagggtatacttgtaattttcttacggtgcactgtactgcttttacgagcttgcgaaaactgtaaacgcttatccacccgtgcgattacggtaaaagcgcgcaaagtgcggcaaaactgataaaaaaatcatcgttttccattgggtaaaaatctgacactgatcatgttatgaaaaaaaataacaacttttttatctgcttttgtcattaacacagcacacaggcgtaatatctgacaaaactgcatttcgatttctttcagagcggaaatcgtcattacccgtgagtctctttacatcatgaatatgctggaaaaaatccagtctcagctggaacatttgagcaaatctgagcgcaaagttgccgaggtcattctggcttcgcccgataacgcgatccattcgagtattgctgctctggcgctggaagccaatgttagcgaaccgacggtgaatcgtttctgtcgcagcatggacacacgcggttttcctgattttaaacttcatctggcacaaagtctggcgaatggcactccctatgttaatcgcaacgtcaatgaagatgacagcgttgaatcatacacggggaaaatatttgagtccgcaatggcaacgctcgatcatgtccgtcattcactggataaatctgccatcaaccgcgccgtcgacttgctcactcaggcaaaaaaaatcgcctttttcggattaggttcttcagccgccgttgcccacgatgcgatgaataagttctttcgttttaatgttccggtggtgtactccgatgatatcgtgctgcaacgcatgagttgtatgaattgtagcgacggagacgtggtggtgctgatttctcacacgggaagaacaaaaaatctggtcgagctggcgcagctggcacgcgaaaacgacgctatggtaattgccctcacctctgcgggtaccccgctcgcccgggaagcaacgctggcaattaccctcgacgtaccggaagatactgacatttatatgcccatggtttctcgacttgcacagctgaccgtgatagatgtgctggcgacaggatttactttgcggcgcggtacaaaattcagagataacttgaagcgggtcaaggaagcgctgaaggaatcgcgttttgataagcagttacttaatttaagtgacgatcgctaaaaacgactgtcactgtcctaatcttatacgacatccgaatgagattaatttatcgccatcgcggcgttatttcattcggatttcatgttcaagcaacacctggttgtttcagtcaacggagtattacatgtccagaaggcttcgcagaactaaaatcgttaccacgttaggcccggcaacagatcgcgataataaccttgaaaaagttatcgcggcgggtgccaacgttgtacgtatgaatttttctcacggctcgcctgaagatcacaaaatgcgcgcggataaagttcgtgagattgccgcaaaactggggcgtcatgtggctattctgggtgacctccaggggcccaaaatccgtgtatccacctttaaagaaggcaaagttttcctcaatattggggataaattcctgctcgacgccaacctgggtaaaggtgaaggcgacaaagaaaaagtcggtatcgactacaaaggcctgcctgctgacgttgtgcctggtgacatcctgctgctggacgatggtcgcgtccagttaaaagtactggaagtccagggcatgaaagtgttcaccgaagtgaccgtcggtggtcccctctccaacaataaaggtatcaacaaacttggcggcggtttgtcagctgaagcgctgaccgaaaaagacaaagcagacattaagactgcggcgttgattggcgtagattacctggctgtctccttcccacgctgcggcgaagatctgaactatgcccgtcgtctggcacgcgatgcaggatgtgatgcgaaaattgttgccaaggttgaacgtgcggaagccgtttgcagccaggaggcaatggatgacatcatcctcgcctctgacgtggtaatggttgctcgcggcgacctcggtgtggaaattggcgatccggaactggtcggcattcagaaagcgttgatccgtcgtgcgcgtcagcttaaccgcgcggtaatcacggcgacccagatgatggagtcaatgattactaacccgatgccgacgcgtgcagaagtcatggacgtagcaaacgccgttctggatggtactgacgctgtgatgctgtcggcagaaactgctgctggtcaatacccgtcagaaactgttgcagccatggcgcgcgtttgcctgggggcggaaaaaatcccgagcatcaacgtttctaaacaccgtctggacgttcagttcgacaatgtggaagaagctattgccatgtcagcaatgtacgcggctaaccacctgaaaggcgttacggcgatcatcaccatgaccgaatcgggtcgtaccgcgctgatgacctcccgtatcagctctggtctgccaattttcgccatgtcacgccatgaacgtacgctgaacctgactgctctctatcgcggcgttacgccggtgcactttgatagcgctaatgacggtgtagcagctgccagcgaagcggttaatctgctgcgtgataaaggttacttgatgtctggtgacctggtgattgtcacccagggcgacgtgatgagtaccgtgggttctactaataccacgcgtattttaacggtagagtaagtacgttgccggatgcggcgaaaacgcctcatccggcctacagttcaatgatgattcaacagatttcgaatcttctgaagcaaacttgaacttatcatcagtcgaaggcctctcctcgcgagaggcattttttatttgatgggataaagatctttgcgcttatacggttggatttcgcccggtttgcgagttttcagcaattttaatatccaggtgtattgttctggtcgcggaccaacaaaaatctcgacttcttcattcatccgccgcgcaatcgtatgatcatccgcctctaacagatcatccatcggtgggcgcacctgaatcgtcagacgatgcgtcttgccatcataaatcggaaatagcggtacaacgcgcgcacggcacactttcatcaaacgaccaatcgcgggcaacgtcgctttataggtggcaaagaaatcaacaaattcgctgtgttctgggccatgatcctgatcgggtaaataatatccccagtaaccctgacgtaccgactggatgaatggtttaataccatcatttctcgcatgcagacgaccaccaaagcgacgacgcaccgtgttccagacataatcaaaaaccgggttgccctgattatggaacatcgctgccattttctgcccttgcgaggccatcagcatggcaggaatatcgacggcccaaccgtgcggcaccagaaaaatcactttctcattattacgccgcatctcttcgatgatctccagcccttgccagtcaacgcgcggctgaattttctccggcccgcgtattgccaactcagccatcattaccatcgcttgcggcgcggtggcaaacatctcatctacaatcgcttcgcgttcagcttcactacgttctggaaagcagagcgacagattgattaacgcacgacggcgtgagctttttcccagtcgtccggcaaaacgtcccagccgtgccagaatgggatcacggaactttggcggcgttaaagcgatacccgccatcgctgctacgcccagccatgctccccagtagcgcgggtggcgaaaggatttatcaaactcaggaatgtattcgctattattttttttcgtttccatgcttttccagtttcggataaggcaaaaatcaatctggtgatagtgtagcggcgcaacttgccccgcaccaaataaaaaagccggtactgactgcgtaccggctgcgaatggatgttaattaatcaaaccgtagctgcggcacaatctctttggcctgtgccaggaattcgcgacgatcggagccggtcagcccttcggtacgcggcagttttgccgtcagcgggtttacggcctgctggtttatccatacttcatagtgcagatgcggcccggttgaacgtccggtattaccggaaagcgcgatacggtcgccacgtttcaccttctgtcccggtttcaccaggatcttgcgcaagtgcatataacgcgtggtgtagctgcgaccatgacgaatagccacataataacctgctgcgccactacgtttggcaaccaccacttcaccgtcacccactgaaagcactggcgtaccttgtggcatggcaaaatcaacacctctgtgtggcgcaacgcgaccggtcaccggattagtacgacgcgggttaaagttagatgagatacggaactgtttcgccgtcgggaatcgcaagaatcctttcgccagaccagtaccgttacgatcgtagaatttgccatcttcagcgcggattgcgtaataatctttaccttctgaacgcaaacgtacgcccagcagctggctttgctcacgtttaccatcaagcatttctcgtgacattaacaccgcaaattcatcgccttttttcagtttgcggaaatccatttgccactgcatggctttaatcactgcgctcacttcggcgctggttaaaccggcgtttctggcgctggcaacaaagcttcccccgacggtacctttcagcagattgttgacccactctccttgctgcatttcgctggtcattttaaaaccgttagcggcagtacggtcataggttcgggtttcacgacgagacacttcccaggtgaggcgctgcagttcgccgtccgcggttaatgtccaggagagttgttgaccgattttcaggttacgcaattctttgtcggcagcagccagttgggtgatatcacccatatcaataccatactgattgagaatgctgcttagcgtatcgccagtggaaacaacatattcatgcacgcccgcttcaccggcgattttgtcatccagttcgtcctggggaatggcttcatcttcttgtgcagcttgatcaatcggctcactggcttcaggtaagagcgaacgaatttcgttctgttccagctcaatggttttgacaattggcgtggcatcgcggtgataaacatagggccgccagacagcgacggccagagtaagaacggtgagcgaccccaacataacgcggtgtggtcgcggtaaattattaaacgccagggcgacagagcgggctatctgttgcacgtaatcacttcctcattaatctcctttcaggcagctcgcatactggttggctaattgattcaggaattctgaatagcttgttttacccagtttgatattcgtccccaggggatccaacgttcccatacgaacggatgtccctcgtgcgacgctctcaacgaccgctggcctgaactgtggctcagcaaaaacgcaggttgctttttgctcaaccaactgtgttcttatttcatgtaaacgctgcgcgccaggttgaatctcagggttaacggtaaaatgaccaagcggtgtcagtccgaactgtttttcgaagtagccgtaagcatcgtgaaaaacgaaataacctttccccttgagcggcgcgagctcgttaccaacctgcgtttcggttgaggctaattgtgcctcaaaatccttcaggttggcgtcaagtttggctcgactttgcggcataagttccactaattttccatggattgcaaccgctgtagctcgcgctatctctggggaaagccaaagatgcatgttgaaatcgccgtgatggtgatcttcgtcacttttttccgcgtgatcgtgatcatcatcatcgtcgtgaatacttttcatcagcagcggtttcacatcttctagctgcgcaatcgttacctgtttcgcttctggtaatttacttaccggtttttgcatgaacgcttccatctccgggccaacccaaacgactaagtccgcgttctgtaagcgttttacatccgatggacgcagtgaataatcatgttctgaagcgccgtcaggcagtaaaacctgcgtttctgttaccccatcagcaatggcagaagcgatgaacccaaccggtttaagcgaagcgacaacggcggcatctgcggcctgtgttgcaccgccccagagagcggcggataatgctgcgaaaagaagcgtttttttatgtaacataatgcgaccaatcatcgtaatgaatatgagaagtgtgatattataacatttcatgactactgcaagactaaaattaacatgacaagtctggtttccctggaaaatgtctcggtttcttttggccaacgccgcgtcctctctgatgtgtcgctggaacttaaacctggaaaaattttgactttacttgggccaaacggcgcaggtaagtcgacactggtacgggtagtgctcggactggtaacacccgatgaaggggttatcaagcgcaacggaaaactgcgcatcggctatgtaccgcagaagctgtatctcgacaccacgttgccactgaccgtaaaccgttttttacgcttacgccctggcacacataaagaagatattttgcctgcactgaaacgtgtccaggccgggcatctgattaacgcaccgatgcaaaagctctcgggtggcgaaacgcagcgtgtactgttagcgcgagcattgttaaatcgaccgcaattattagtgctggatgaacccactcagggcgtggatgtgaatggtcaggtggcgttatatgaccttattgaccaactgcgtcgtgaactggattgtggcgttttaatggtatctcacgatctgcatctggtaatggcaaaaaccgatgaagtgctttgcctgaatcaccacatttgttgttccggcacaccggaagttgtttccctgcatccggagtttatttctatgtttggtcctcgtggtgctgaacaactgggtatctatcgccatcatcataatcatcgtcacgatttacagggacgaattgttttgcgtcggggaaatgatcgctcatgattgaattattatttcccggttggttagccgggatcatgctcgcctgtgccgcgggtccgctgggttcgtttgtagtctggcgtcgtatgtcttatttcggtgatacgctggctcatgcctcattacttggcgtcgcgtttggtttgttgctggacgtgaatccattctatgcggtgattgcagttacgctgctgctggcgggcggtctggtatggctggagaagcgtccacagctggcgatcgacacgttattagggattatggcgcacagtgccctgtcgctgggcctggtggtcgttagtctgatgtctaatattcgtgttgatttgatggcttacctgttcggtgatttactggcagtgacgccagaagatctcatctctattgcgattggcgtggtcatcgtggtggctattttgttctggcaatggcgcaatttgctgtcgatgacgattagcccggatctggcgtttgttgatggtgtgaaattacagcgcgtgaaattgttgttgatgctggtgacggcattgacgattggtgtagcgatgaaattcgtcggcgcgttgattattacttcactgctgattattcctgctgctactgcacgtcgctttgcccgcacgccggaacagatggctggtgtcgctgttttggtggggatggtggcagtgactggcggtttaaccttttccgcattttacgatacacctgcaggcccgtcggtggtgctatgcgcggcactgttatttattatcagtatgatgaaaaaacaggccagctaatctttcgctgaacatatttgtcggatgcggcgcgagcgccttatccgacctacggttcgctatctctggtaggcctgataagacgaacagcgtcgcatcaggcacactgccagtgtcggatgcggcacgagcgcccaatccgacttacggcatttctggcggcgttatgccaaagtgattccacgcccgcgtcgtcgccatacgcccacgcggtgtacgctgcaaaaagccttgctgaatcaaataaggttccagtacatcctcaatggtttcacgttcttcgccaatggctgccgccaggttatccagacctaccggcccaccaaagaacttatcgattaccgccagcaacaatttgcggtccatataatcgaaaccttcagcatcgacattcaacatatccagcgcctgagcagcgatatctgccgagatggtgccatcgtgcttcacttcggcgaaatcacgcactcgacgcagcagacggttggcaatacgtggcgtaccgcgcgcacgacgagcaacttccagcgcgccgtcatcactcatctcaagccccataaagcgtgcgctgcgactgacgatatattgcagatccggcacctgataaaactccagacgttgcacaataccaaaacgatcgcgcaacggtgatgtcagcgaacctgcgcgcgtggttgcaccaatcagggtaaacggcggcaaatcaattttaatggagcgtgccgccggaccttcaccaatcatgatatccagttggtaatcttccattgccggatacaacacctcttccaccactggtgaaagacggtggatctcatcaataaacagtacatcgtgtggttcaaggttagtgagcattgctgccagatcgcccgccttttccagcaccggaccagaagtcgtgcgtaaattaacgcccatttcattggcgacaatattggcaagcgtagttttacccaaccccggaggaccaaaaatcaatagatgatcgagggcatcgccgcgcagtttcgctgctttgatgaaaatctccatctgcgaacgaacctgcggctgaccaacatactcttccagtaatttagggcgaatggcgcgatctgccacatcttccggcaaagtggtaccggcagaaatcagacggtctgcttcaatcatcctttacctcataacgcggcgcgtagggcttcgcgaattaatgtttcactgctggcgtcagggcgagcgattttgctcaccatgcggcttgcttcttgtggtttatagcccagtgccaccagcgcagcaaccgcttcctgttcagcatcgtcagtcgccgggctggcaggtgacgtgagtaccaggtcggcggctggcgtaaagagatcgccatgcaaacctttaaatcggtctttcatttcgacaatcaagcgttcggcggtttttttgccaatacccggcagtttcaccagtgcccccacttcttcacgctcaacggcattaacgaactgctgcgctgacattccagagaggatcgccagcgccaacttcgggccgacgccgttggttttgatcaactctttgaacaacgtgcgctcttgtttattgttaaaaccgtacagcagttgcgcgtcttcacgcaccacaaagtgggtgaaaacgatcgcttcctgacccgcttcagggagttcataaaaacaggtcatcggcatatgcacttcatagcctacgccgcccacttcaattaacaccagcgggggttgtttttcaatgatgatgcctctgagtctgcctatcacatgacgctcctgcgtaatgaatcaaagataatgctgtatgataaaaaaatgctggatagatatccagcgaaggatgaagaaaacttgcgaggtgtctcgatgatctgaaaaatggcgcagtataatttattctacaggttatattggaagcaaatatttaaatattacatattcagcgaagaaatgtgtaataaaaatatacattgcgactcctgaaaaaataaattttttatgctattacgtatattcatatctatttcaatggaatgacaacgtgaatattaattatcctgctgaatatgaaattggtgatatcgtctttacatgtataggtgctaccttatttggtcaaatatcagctgcatcaaattgctggagtaatcacgtcgggatcattatcggtcataacggtgaagactttctggttgcagaaagccgtgttcccctctcaaccatcactacgctatcccgttttattaaacgctctgctaatcaacgctatgctataaagcgattagacgctgggctaacagaacaacaaaaacaacgaattgttgaacaggttccctcccggctacgcaaactttaccacaccggttttaaatacgaatcttcgcgccagttctgttcaaaatttgtttttgatatttataaagaggcgctatgtattccggtgggtgaaatagagacgtttggagaattgttaaatagcaatccgaatgcaaaactcactttctggaaattctggttcttaggttctattccgtgggagcgtaaaaccgtcacgccagccagtttgtggcatcatccgggtttggtgttgattcacgcggtgggagttgaaacgcctcagcctgaactgaccgaggcggtataacttaacgcagtcgccctctcgccaggttcagtcgcgattcgctcatttgcatcgcattctgactaacgtggcagtgggtgatggcaatcgccagcgcatcggcggcatccgcctgtggattagcgggcagtttcagcaaggtgcggaccatatgctgcacctggcttttttcggcactaccaatacctaccactgtttgctttacctgacgtgccgcatattcaaataccggcaattcctgattcaccgccgccacaatcgccacgccgcgcgcctgccccagtttcagggctgagtcagcgttcttcgccataaagacctgttcaatggcgaaataatcaggctggaattgggtgatgatttccgtcacgcccgcatagatgagcttcagacgagacggtaaatcatccactttggtgcgtatgcatccgctacccaggtaggacagttgcctgcctacctggcggatgacgccatagccggtcacgcgcgaacccgggtcaatgccgagaataatagccatcacgcgtctccgttttgctgtttagcaggcctcatcagagagtcgctgcaacctcatcagagatttcaccgttatggtaaacttcctgcacgtcgtcgcaatcttccagcatatcgatcagacgcatcagtttcggtgcggtttctgcatccatatcagctttggtggacgggatcatggaaacttccgcgctgtctgctttcagacctgccgcttccagagcgtcgcgtactttgcccatttcttcccatgcagtgtagacatcaatcgcgccgtcatcataagtcacaacgtcttcagcaccggcttccagggctgcttccatgatggtgtcttcatcgcctttctcgaaggagatcacgccttttttgctgaacaaataagctacggaaccatcagtaccgaggttaccgccacatttgctgaatgcatgacgcacttcagcaacggtacggttgcggttgtcagacagacattcaatcatgattgccgtgccgccaggaccgtaaccttcgtagatgatggtttccatgtttgcatcatcatcaccgcccacacctcgtgcaattgcgcggttcagagtgtcacgggtcatgttgttagacagtgctttatcaattgctgcacgcaaacgcgggttagcgtccggatcaccaccgcccagcttagccgcggttaccagctcacgaatgattttagtgaagattttaccgcgcttagcatcctgcgcagctttacgatgtctggtgttggcccatttactatgacctgccataaaaatatctccagatagccctgcctgttcaggcagcgttaattacaaactgttcaatcgcctgccggttgctccaggacttagtgagcgccgccgcagcagacgcatcaagccacttgtaagccagatgttcagtgaaaacgatctggcgctcgtgcggaagcgcaagacagaaccatgattccgtattacgcgtcacgcccggcgcatagcgatgacgtaaatgtgaaaaaatttcaaactctaccgtgcgctgacagtcaattaaggtcagttgttcagcgacaacatcaatggtgacctcttcctttacttcgcgcatggcagcttgcggcgcggtttccccctcttccacgctgccggttaccgactgccagaaatcgggatcgtcacgccgctgcaacatcagcacccgtttcgtatcttgtgcgtagatgaccactaagatcgaaacgggacgcttataagccatatcagttattctcagccttcttcacaacctgaatgctcagctcagccagtgcagtcgggttagcaaagctcggtgcttcagtcatcagacacgccgccgccgtggttttcgggaaggcgataacgtcacggatattgtcggtgccggtcagcagcatcgtcagacggtcaagaccgaatgccagacctgcgtgcggcggagtaccgtatttcagggcgtcgagcaggaagccgaatttctcgcgctgttcctcttcgttgatacccagaataccaaacaccgtctgctgcatatcaccattatggatacgcacagaaccaccgcccacttcgtaaccattgatgaccatatcgtaagcgttagccaccgcattttccggtgcagctttcagttctgctgccgtcatgtctttcggtgaggtgaacggatggtgcattgctgtcaggccgccttcaccgtcgtcttcaaacatcgggaagtcgataacccacagcggtgcccatttgctttcgtcggtcagaccaaggtctttacccactttcaggcgcagtgcccccatcgcgtcggcaacaattttcttattgtcggcaccgaagaaaatcatatcgccatcttgcgcgccagtacgctccaggatggcttcaatgatttctgcattgaggaacttcgctaccgggctgttgataccttccagacctttcgcgcgttcgttaactttgatgtaagccagacctttcgcgccgtagattttaacgaagttaccgtattcgtcgatctgcttacgggtcaacgatgcgccgcccggaacgcgcagagcggcaacacggcctttcggatcattcgccggacctgcaaatactgcaaactcaacagatttcagcagatcggcaacgtcggtcagttccatcgggttacgcagatccggtttatcagaaccataacggcgttctgcttctgcaaaggtcattaccgggaaatcgcccagatccacgcccttcacttccagccacagatgacgcaccagcgcttccatcacttcacgcacttgcggcgcggtcatgaaagaagtttccacatcgatctgagtaaattcaggctgacggtcagcacgcaggtcttcgtcacggaagcatttaacgatctgatagtagcggtcaaagccggacatcatcagtagctgtttgaacaactgcggggattgcggcagcgcgtagaatttacctttgtgcacacgagaaggcaccaggtagtcacgcgcgccttcaggcgtggctttggtcagcatcggagtttcgatgtcgaggaagccgtggtcatccataaaacggcgcaccaggctggtgattttagcgcgggttttcaggcgctgagccatttccgggcgacgcaggtcgaggtagcggtatttcagacgcgcttcttcggtgttgacgtggttagagtcaagcggcagaacatctgcacggttgatgatagtcagcgaggacgccagtacttcgatttcgccagtcgccatatcgcggttaatatttttttcgtcacgcgcacgtacggtgcccgtgacctgaatgcagaactcattacgcagttcagaggccagctttaacgcgtccgcacgatccggatcgaaaaatacctgcacgataccttcgcggtcgcgcatatcgatgaagatcaggctaccaagatcacgacgacggttgacccaaccacacagagtcacctgctgccccacgtgggacaaacggagctgtccacaatattctgtacgcatgagatatcccttaacttagctgccggcggatgccccctgctgcgcaggtgaccaagtcgcagcgttagctgtatgtcacaactgaatgaaaaaaggcggctattatactggaaattctgccgcaccgtaagagcctagcccgcgctggaacgcctcgttaccactttatatcgggcctgaaatcagactctacgccagtttgctataaaggtgttgcccgaactcataaaaattaacaaaatttgtcgttccgccatcggctaatcgcattaaggtgagaggcacgattttgttttatcaggagtcatcatgcttgaacttaatgctaaaaccaccgcgctggtggtgattgatttacaagaaggcatcttgccttttgccggtggtccacatactgccgatgaggtggttaatcgcgccgggaagctggcggcgaaatttcgcgccagcggtcagcccgtgtttctggtgcgtgttggctggtctgccgattacgccgaagcattaaaacagccggttgatgccccttcccccgctaaagtgttgcccgaaaattggtggcaacatcctgtagcattaggtgcaaccgacagcgatatcgaaatcatcaaacgtcaatggggtgcgttttacggtacggatctggaattgcagttgcgccgccggggtatcgatacaatagtgttatgtgggatctcgaccaatatcggtgttgaatccaccgcccgcaatgcctgggaacttggctttaatctggtgattgccgaagatgcctgtagtgccgctagcgccgagcagcacaataacagtatcaaccatatctacccgcgcatcgcccgtgtgcgtagcgttgaagagatcctccacgcgttatgatttacatcggtttgccacaatggtcgcatcctaaatgggtgcggttggggatcaccagccttgaagagtatgcccgccactttaactgcgtgatacgggatttttaaaaatcactaaagaacgcccaagagcatgtgttttctttagtagaatcaaactcttgaatttccatgtcatatgaaaatcggcaaagttcatatgtaacaaagtgtcccaaccatgccccaaaatgccccacaacagacatttttgtcccatgcatgccccaaaaaaatcacttcccctcaccttgacactgtttatacatacagttaaaaataatactgtacataaccacagttacaggagggtgttatgcgtgttgagatctatatcgctaaagaaaaaatcagcaaaatgccaaaaggttctgttcctgccctgcagcaagaaatgctgcgacgtgtcagtaaacgttatgatgatgtagatgtgatcgttaaatctgccagcaatgatggactcaccattttaagagctgtagataaagaatccgcgcacgaatttgtacaggaaacactgcaggaagcctgggaaaccgctgacgactggtttattcaataacgcaatcataatcacggcaataacatattttttatgactttatccgtcccgcatgacataacaactatctggtagttataagttgcttcttctggttggggagtcggaaaactccccctttctgatcatcctgttttacccgcttaaccagcaacctgcctcagattcacaagtcactttttgtatggtataaaccggcgctttaatacaatttacagccctggcattttctggcggagagtgcgaaactcccttttttacggcatttctgtcggaactcatatttttcctgcatatctgacacttgcgtattttcatggaaggagatcacccaataaccccgatctccttcatgttaatacgcagtcagaatgaataacggaagccggcgttgacagcattatcaacgttgtacttaccaaaggctgatttctcaaactccagaccaaaacggatgttgtcacggacctctgcgttcagccccacagacatcagcatacggccgtctttctcgcccttgatacgcttctctccggatgcatcacgcagtaccgtttctccgttcgccagcaggtcaaactggtagccaagaccggcacgtgccgtcactttccagtccttaccggagaacgatttacccacatccacaccggtacggccaatcagcggattgtagtccttgtccttcatggacaggctcatcccctggtccttccagctgaactgtttcccggagacagcaccgtaaacaagttccgcctgtggctcaatccaggcatcctctgtgacatgatagcggtaacccacttcagcaccggcataccaggaatgagagccgtagtcttttgtgccgagtccggcaaaggtcgccgtatactcattatcatggtgaacatacttaccaatcaggtcgatataggccccggaatcaaacagggctgaagcatacagacccgcccccactgacttcgttttaccactgaaggtgtcgctgccggcgttgctgtcggtatatgtcatggtcaccccggtgaagaggtccagaccgtccagttcgtgttttttatccgcacccacctgaacgtgtgtgtagttgtcactgaagccaccaccggcagagccggttccgctcatgatacgggcccatgcaccggcctcgccgttgatgtcccgcaggtcacccatacgtttgttcaggttgttgacctcattaatgaagttacggtgccccattgacatcagcatcccggcatccctgaccgcagagacattaaccgtactccggtatcctgtcagcagccaccgggtctcatcacggtactcacctgattcccccgtattctctccggtcagtacatccgtcactgacgcctccggagccggtgacggagcagaaaccggtgaagggagcggtgatacggcttccacaggattcggcgtctttgcatcctgccgcatcaccaccggcaacgacggcctgctcacctcatccaccacaggctctgcggcagtttccggctgcacaacattcagctgccaggccgtgccgcccgtcccctgttcagccctgacaacaggtgtgatatgactgaagccggtatcacgcgttttcacactgaacacatccgcgccggtaccggccggcgctgtcaccagagggatattcagcgccttctgcccgtcagaacgctcagtaaaatcaaccaacaacagattattcttaccccgcagcgattctgtcacccgaagctggtctgagtggtgaaggtccgtccgcatcaccagaacactgtcgctgatatccatactgcctgccgtcagggtatggaactccccgcccggcctgctgaaatacagagcacttcccgatgactcaagatgcttcacggatgagtttcccgtcatcatccaggtcgcattctgcagattcacattacctgcactccctctgacataaccccgcaggagaccagctgcccccgtcataaaatcatactcaccgcttccgttcagcccgccacgctcctctgaccaggccagcagacgttcatacacatcattcctgacacttcccccgtcaaccagaagggttcctccatccagtgtcacaccaccatctgtctccagtccccccttcacatgtaaacgcccgccgtcactgacagtaagtgcagaagacgtcaggcgggaatccccttccagacgcacattctctgagttcacgactatccggctgtccgatgccgttatactgccggtaaaatggtcgcggaccgtcagggaagaatgacgcatattcacattcccgcggaatgtactggtaccggatgcaccgcccgcagcagacgtccccttaaccggcgcactgctgctccccgtgccgtccttcatatccagatacagcgagtcacttcccagcaccatggtggcattatcagcatcaatatctcccgtcagtgtcgcattgcgggaaaggctgaatgacgcttccttcagtttcagttgcccgatgctgaacgtcctgctctcccagtccttctgggtaaatgataccggccgcgtcagaacagaattatcaccctgctttcgcaatgcagccgcaaccgcctcactgctcacggcatgaacaaccggatgcccctggatatacagtcccccgccctgctgtgtaaaactgccggacatatccgctccgccatccatgatgaaatccaccgctgatgacgtgttgttcaggacactgaggttgccggtaaaatgaccatgccacatcacggccttctgccctgacgggctgaaatccagacgaactgtggcagaacccgcccggcttgtgagtactgccccctcatcagccgcagccagccggtggaaggtcatatcattgccgttgatatcaagcgtgcctccccggtatccccagcggatgcggtccccctcaatctgatgactgtcctgcagcaccacaaccggccgtccgctgacaatacggacttcactgaatgcccggaccctgcctgcagcatcagccttctgtgccagaataaccgttccgtcccccgtattcagggtgccaggattttcaccactgccggccaccaccagtgttcccttaccagttttatgaagtgcgtctcccgcaagtccgttcaccatccagtcaacacggtgcccgtcgttcacgatgattcccccgcccacccaggtctgattcccttccggtctgaccgtataatcaccattaaacgtgagcgaacccgccccctggacaacatcatccttcagaacaaccgtgcccttacccccaaaggtgatatctttcccgtcattcagactccctcccctgaagccgttcatcttccataccttcccgtcctgagaaagggttccctctccgcttcccttactgtaattccacacaatgtcaccaccggcaactgccggcacgacagtgcctgaactgtcctgctttatcgtgttattcacatcccctgcgggaatcaccgtaaaccagttcgtcttccctttctcaccggcataaccattaagtacagcaacaaggacccactgcttcttcaccgcatcccaggcaaaaagcggtgagccactgtctcccggtgtcccgtaagatgccagcggaccattgacactctggtacagataccccgggtttgacaccagactccagtcagaaatgagcggacttcccaccgtcccgcccgtcttccaggcgtaagcacccgctattctggtcagcgcaccggaagcagctccggtgtactgcgttccactccccatacgataaaacaccggataacgactgcggttctggtatacccccttgccggttccggcatccgtgacgctcaccggggcaacttctgtcaccagtttgttcagccggggagtatgaaaatcacgccagtgctcattacggtcaacaaggcgatatgtcgtatcatccgcataaccaaaacgcaccgtgttgtagctgccgttatgcttaacccccgccacatactgcggagaaatcagtgttgccacccccagtatctggtccacaacactgaaatccatcatcggcgccttgtccagccgcccaccgacagccccgttcctgccataaagcggaatatttgtggcaccggcatgaaacgcgcccttgttctcagcaaaatccctgtaggtctgccaggggagggtattcccgacaacggatgccagcgacggataagaaaacagaacaccggcaacggcaccagaggccagaagaagacgggaaagcatccccgcaccgggaatgccggacgactttttcctgccgcccgccgtttccgctaccgcaaccagttcttttctgtcattcattctgagagaatatattctgttcattccccggtttccctgtcttttcccggacagcagtcaacagtgacgcctgcccggatatctgttaacgaatctgacgaatactgccgccagattactgaagcaacacagctgccgcggtaaaaagagccaccaccccacccagccacacaaacaacatgaaacacattgcgcctgtggtgtaacgctttctcccgtatctccggtctctgtctttgttcatcatctgcaccttctgaatcatcagaagatgccgcgcatccggcaggaccgccatcaggcaccaacaagccgtctgacactcacaccatacagcccgtttttcgccattcccgtatacagaaaggtattcaccgtctttgtgttaatacccatttcactggcaaggcgacagggtctcgactggcggtagacataaccgaacatcaccaccatctctgacatcgtcagcgggcgggcagcactgttatacgtccagacgccgttgtgtatggcatcacttatctgctcaccatcacgaagcaactccgcatccagttgcagaaaatgacgcccctggaacatacaccgcatcagcctgcccagcaggccatcactgattatcagccaggattcgtcaaagtccgggatataacggcggttctccggcaggaaaaactccctcgccagtatcacactgtgttccttcagcaactgttgcagtccatattccaggtagcggttccttgtggccagaattaccttcatcgcagcaccttcctgtttttatgccccatgaaaaacggcagaccagagtcctgcgcctgccgtcatacttcatgtcaccttcagcaattaaaactcgaagttcacaccaacgttccaggaggcatcgccatcactgaatgccacgcctgctttcgctgcggtctgctcgttgaagcggtaacccacacccaccgccagtgcctgctggtcgctgtaaccaccaaccgctgccgtggcgttgaatttacccacactgtacggctggaacagacctgtcagggccgcagactgtgctgctgctcgtttcatttccttatggttttcattaatctggcgctgctggctgtccagacgtgctgaatgttgctgcagcgtacgggtattggctgcaatcgccttgctgtttttctcaatggattgcgtgttacgggtgacacggccatcaatggcaccaactgctgcatcaatacggtcagtacgaccagacagggccaccagaccatcgttaacagaaatggtgttctttgcaccttctgcacgggtcagggtgccatcagaactcacaccaaccagtgtgcgggattcgactttttcgttaacctcactggtcttctggtctgtgtattttttctgcttctctgactcaacagttatacgggctttaacatcatcataaactccaccaactttccggtttaactgcccaacagttgccgcatcactgttacgcgtaccatcgcttaagccaccaagaacacgggtgccgtatgttttatcgctttcggttccggttttatagccaatataaacttcgttatcacgagtggttacagaattagcacctaatgcaacactgtttttatttgttactgttgcctttgcccctaacgcagtaccttctgttgcatctttatcaactttggctcggttacctgctgccgtgccatatgtagccgtgtaatcaacaaatgcaacgcttcccagggctgtagatgcatttgcataagcatatgttcccactcccagagctgtactttgtttaccgtccgcagcagcccatgagcccactgctgttgacgctttttctgtagccctagcatcgttaccaacagcaacggtgtattgttcgctggctacagcacctttacccagcgcaggtttaagcgcaactgtacgggctgcttcagatgctgcgtcaatatatcctttcaccggggcgttagccttgctgttcttattgacgtccttgttatatgggccagtgtttttcttagcaagaatgtttttctcatcaagaatgtacttaaccatcgttgacacatcgcccgctttaactttggtgcgttccccgttatatccggttacgtaaacagagccgtctttttctatatctgtaagtccggggatggcgacttcttttttattattatcgattttcacaagtcgaaatgtcgcactatgtccaccgtcatttctggacaagcgatattgtgtgccatccgactgcttaccaaatgtataatattcttctgttgattctgctttcgttgatactgctttcgcttgcgccgatgcattacccgccagaaacaatcccgccactgcggcagaaagaattgttttagtgaattttttgttcatctgatatatcctgtaatttctttgtatacaaaaaaagcaaccctctcagacgcacttcagatacactaaagaaaatctgataactggctgcttcctgccagcttattccaggattattcgcaaaaattaatataaactttttaggaattatcgtactgtacagtcggtgatatccgtcatccccgccattattcacgctccacaccgcatgctgtcgtttcgcttatttccctcacgcacttatgacacagttccttacgcttaataatgtgacaagcaccacattctgattttttgtcgatacattaataatattaatcgttttctgacataccgctgccatccgcgttccggagcgtgtgacaggcatcactgaatatgcctggcggttattgcagaatctgtttcacaataaaaaaacgattgctgtaatcctctattgacgaaagagggggtgaggcatcacccccgtttttttatttacgactcctgacccaccttatacgccagaatctcatccgcactgttcagcgcttccagtgccttcttcatgttccgctgccgtacgtgaatttccatccctttggtgaacatcgccttctccgccgcctcactgagtgccatcagcgcctctgccgtcatcgggacgtcgttattctccgcatccgtccagaaaaaaccctccggcagtattcctgctttcgcggcagccactgacggctcaagacgcgcctgtgtctgtttgccgtagtcccatttacgcccattgtgctcaaacgtgtagttcgccgcttccatcgcattacgccaggcgttgatcccggctgttttgagttctctggctttttccgggctgatggatggctgtacatattctgcaatttcaccggcctctcctctcagacaagcggcataaatatcccgcccgtatgcttcggtatcgctggctgttgcagtgaaaggaaccgcctgctcaatgtgctcaaacttcaccatgcaattgacagcagtgtgctctttatctgcccattgcggattgcttatttttttccacattcatgtcatctcctgtctgtcagtatgcgcgctggaacagcccgatgctttcattatcatttgtcgacgtaatttcattacacaccatccatgagcccggaactgaggatagtatgccgtcaatgccatcggtgttagctttcatatagtttccgttttcgtctttgattagggcgcatcgcttaaggcgtgaacccgatacagtttctcctggctgataggttctgccgatgtcggttatatacgggcctagtgcggcaataatgtatgttccgatgctgtaaatttccccgggtaccagccttccggttggcccttgtggtccctgtggtccggtttcacctgtcggtccctgtggacctgtcgggccctgtcttcctgtttctccctgcaaacctcgtggccccgttttacccgcaggacctgccggaccaaccggccccggaacaccctgtgcccccgctggtcccctttcacctcgtggccctgccggacctgccttaccttccgctccggcggtaccatcctttcctgcggggcctgccgggcctgcatcacctttgggaccagctgcaccagccggtccccgtgggcctgcgggccccactgcaccaggtgcgccaggttcccccctgtcccccttcggtccggggactgctgcccgggttgctgcctcttctgccttcgtttttgctgcctgcacttctgccattaccgctttcacagcctttggggttgccgcttttgtttcatcatcgctgttggtatcgctgctcagctgtacaacacctttctgtgatgtgctggcatccggaacactggcgacactgcctgcgggacccgcaggacctgcggggccggtttctccccgagggcctgcgggacctgccggacctgttgcgccgggttcacctttatcccctttcgggccggtttgccctgccggaccctgtggtccgggtggtccggcctctccacgtgggccggtgtcacctttcggccccggcggtccgcccgggtcacctttatcgcccttcggtccctgtggacctgtttctccccgttctccctttggccccggctcaccttttggtccgaccgcccccgttgccccggctggtccctgtgcccctgtggcaccctgtggacctgtgtcccccttctcgcccgccggtccccgggcattctctgcccgtttcttcgcttcctctgcactcgccgccgacgcttcagcacgcttcaggatttccgctgccaccgcttccagctctgcaagcgctttcgggtaatactgcgcctcatcctgttccatcagaaatttattcagcgttcccggctcagaatccgccttcaccagaatgtcacccacatacgacggagcgtacccttccgtgttcagcgtcacccggtaccaccccggctccacatcaaaactgtaactgccggtttcccccggctgcccctgcgccaccgtggtgactatcactgtctctgtggtgcgtcgcgctttcagctctatggtgcatcccggcaccggcttcccggtgccgtccttcagcacgcccgatattctgactgtcatagatttctcccataaaaaaaaccgcagtaccggttacccggtctgcgatcaggggtataaattgtgactggctggtgttaaagggtgccgtcagtcaaaggcacccgtggataatgtacgatgtccggcttttgtcgttttccggcaatcacgaacagatggatgaaacctcactatccacctgtcacgatgcggtatcaaaatcgtctgtataggatttcaggtaaaacagaaccgggtcatggatccgaattttactcttatcatgaagtattgaaccacccatgtaaaaaagcacatctgcttcatacctgaatgtaatttcaacccgcacatcaccctgtccggcaggaatactccatgagcctgacgcacttccgccaacatcagaatataccggctcatatctgctggcgtttttggaaatctggacctcccgctccccggttttgactttgcctgacctggcatgaacgacaactttgtcatttatcttcatgatgaattcacctctggaaaatgaatacgccataagcataagcttgcgatcaaacggcatgttgtctttcagcaaaatcattttctgaaaagtcagctggttctgagtcattacgccctgccccatatcaaccgtgtatcccttgacgatatcaccaatgattcggtcagcgctcatcgttccattaatggtgcagtcttccgcaatcgtcacgttattcagcgtaccggaactggcactgatattcccgctgatatcggcattacgggccgtcagcctgccgtccggcgtcagggagaatgccgggggattgccgccgctggtaatggtgggggcggtaagaacctttatcagggcctcattgataaacgtctgtcccccctgcgtgaccagtgcgggtgtggtatcaccattctccggattaatgaatgccacacggtccgctgccagcagtatctggctctgcatcccgtcaggggtgttctcaataccggcaccgataccggcaatatagcgacgaccatcctgcatctgctgtagcttcaccgcccacatgctgttcaggtcattatttgtgtccgtctgcacacgctggatttgctgtatggtggcgttctggtcctccagcgttttactgaccgtctgcgtgatttcattgcgggtttctgtgatggtggtctgcatttccgccatctcgtccttcagctgactgttgtcaatctctgcccacagcgcctctgccagatgcgtttttcctatcttttcccggaaaagttccagatagcccgcagcatcattgctcgcccgtccactggcttccacaaaagcagatttacccaccaggttgacgctgcgcacataaaaccagaaatcctttccgggcttaatgtgcggaccggagacgctccactggctgccggtaccaagataacgggcagaggtttccacctgtgcggcgtctgcaatttttgcctccgaaaaccagaactcaaactgcaccgtcgggtcatacaccgcaagacgcggtaccgccgttatctgaaaataccccggcgtcagttcaacaccggcaggcgctgccggtgcgttaatccggaacgtggtggtggccggttcgccctgctggccgtagctgtttatcgccctgaccgtcagggtgtattccccgggaggcagaccactgaaacggtgctccgtatcggcagtgatggcggtggtcagcaggcggctgttctcaccgcttccactggtcaggcgcagactgaagcgcacgcccttcaccacccgcggcgtgtcccatttcgccagcgccagatactggctgtcagccgcgctcacctccaccgtcaggtgctgtactgccggtgggataacgctgttcagggtgcctgactgcggctcaaagcgggctccgttatccacaatggcttctttttccggtacgtgctgcaccgccgtgatggcaaaggtgccgtccgtgttttcccggatggccacacagcggaacaggcgacggcgcagtgacggcagggagagtccccacaccccgtatgtctccacaccatcaggcagggtactgacctgtatccggtccggcgcggggtgtgcggtgatgtccacactcaccggcttaccgctgccgttaatcaggttcaccgccgatgtacctgtctccggcagggtaacctcacggtccagcgtcagggtgcgggtggcagcatcaatggacaggacacgtccgccggtcagggtcccggcatagtcattatcacagatttcaataatgtcaccgggtgtgtgccgcagcccctgagacccgagtgtgaaatcaaccgtctgcgtttccagcagttcggtctttatcacccacagcccggcacggtgggcctgaccgcggctggtacagccgaacgcgtccatcttcagcaggttgcgtccgtagcgcagtatggcttccgggtcttccaccagttccgtggaggtctgccagccgttctgcgggtcggtgtaattcacctccaccgccgtgtgccggtccttcagggcactgaagctgtagcggaaccccacgccgttatcatccaccaccacatcgctgttggtgtacggccacaccacatccgacggacggtcctgaacgaacgtcagcgtctggccgttccataccggcatacagcgcatcgccgagcagaaatcactgagcacgtcccatgccttacgctgttgtgccaggtacgcattaaaggtcatccgcggctctgtgcccccgaaaccatccgggaccgtctggtcgcagtactgcccgatggcatacagcgcccacttgtccacatccgccgcccccaggcgttttcccatgccgtagcgcgggtgagtcagcatgtcccacaggcaccaggccgggttgttgctgtatgccggtttcagactgccgtcccagataccactgtacgtgcgttttaccgggtcatagtttgacggcacctggatgatgcgaccgcggatatggtagttcaccgtcatctgctggccgccgaactgctccgcatccacctgcagccccacaatgaccgtgttcgggtagcactgtttcacatcgatgatttcggtgtatgacgaccagagcgtcttattctgcagctggtccgtggtgctgtccgccgtctccctgaccatccggatgttaaagggccggggcggcagattatccagaatcaccgacgccaggaactgcgaggtggtcttgccgttaatggtgacatccttttccgtcatccatttaccaccacgctcaagctgaatcagcaggcggacagaggacggattacggtcaccctttgacgtggtctccaccagtgactgcaccccgaaggtcacccgcaggcggtcaatgttcgctgacgtaatggtgcgtgtcaccggttttgccttcgtcacttccacacccagtacagtttcagctccggaggactcaaagccttccggtggtgtctgctcctgctccccggcacgccagacggcggtcacaccgtgtatcacgggattaccgtccgtgtccgtcagcggggttttgttcaccagaatactctgcagtcccttcaccggaccttccaccggtccctcaccaatggcatcaatcacactcatcatctgcgtggatttgagattatccttcgcctcacgcggtgtgtgccccttgccgccccctttacccactctgtccccctctcctgtctgatgtctgaatctgtttatgcccaaaaaacaacaggcaccccggaggatgcctgtatcatgactgaataaaaattctgaatatcttcacattttcacaaactgactgtggcgcgtataatttcgctgcgttagtgtttttttgccgtgacataaaaaaacaactccttaacactaatcttcatttgtctgaatctcccgcagctccgcaactctgcgggatttttttatgccgtttacccctgccgcccgataaccacgacccttccgcccccgccttcatcacgggtgctgatgtcctgagagatacgtcgtgaaccaaccagcatttccccgtaaggcaccggcatcgggttaccctgggcaatcatgttgtccagcgaggaaaagtacgtgttctgtttaccgttatccgttgccctgtattccggtgtttttgccttcggggccagcatctgtgccacaccgcccagtatcatgctggctccaagtgaaaacagcatcgtggtagcagaaaaaccaccggctgccagggctgaaccccataacgccattgatgccccggccgtgaagaaagaccccacaatggcagctgcccccagcacaatctgtagtccgccctttccggcaccggccagtcgcggcacaatatggataaccgttccctcacccagtggttcgtgaaggcgggcatacaccgcctccggtgccgtatcctcaccggcaatacgtatctggtaccagccttcgttcatctgacggcgaaagcccggcatctgcatcgacagggcgcggatggcttccgctgccgtgttcacatacaggctgaggcggcggccaaatcgttgtaaatccccgtgaaggcagatgcgtgccagtggcggtgacgccagacagaatgcgttcgtcgttgccatttttcggaatacctctcccgtttactcagttgttcaggaatatggtgcagcagctcgccatcaccacagtaaatggcggcatgattcggcaccgatgaaccaaaacagcacagcagcacatcgcccggttgtgctgatgacaacggcacctgatacagccctgtggcctccagattatccaggtacaggttctggccgttgcgccaccagtcatcctcgcgatgaaaatccggcatttcagtccccgccagatggtatgcatcccggaacagggtgtaacagtccgtcacaccgtgctcaaagcgccgtcccgtcaggtgtggcacacagcggaatttgtgaatgtcaccccggctgaccagccaccagggcagtgcgctttttatctgcagccgccggtcagcctcgctcagccagggcagcccaccgggatgactgtggaccagtgccacaatctccccctgcatctctgcccgcagccagtcttccggtgcgatacgaaaatacgcctccggctctgcggaaatattcacacaagggatataccgctccccctccggcgtgcttatcacgaagccgcacgactccgcaggcgcacaccgccgggcatgcgccagaatcgctgattcagtctgtgtcataaaccgggatttactgcgaaagtttattaatggaaaggaaaccgccaaaattgccgacattcctgcgcagttcacacccgcgcatgcacttgctgcatctgtccttacggatatcggtggtgggtttatcgaactcatccgccacagccccgcccgtgtaaccacactcatcagagcggtaggtccacatacaggtgttcgccagcatgatacgaccgggaaacagcgccccgtccgtctccgtcggtgtggccagcacaaacgaggccgtcatggctgtcagctgcgacatctgctccaccacccagcggtcactcagctcctgctccgggtccgcttccggattgcccgcaacgaaattcaccgcatccagaaaacgggcatacacccggcggcggaccaccgtggcccccaccagactctgcaggtcttccgccatcccggtgacaaggccaaacagattggacaccgtcagcaacggtctggcactgctgcccttcccgctcatctcaaaaccgctgccgtcaatcgggtatgcctgatattgccgcccctgccaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtgcatcaatggcatagatcggcataagttcaggaagaccagctacctttgataatttctggtatgcaccaagtttcgaggagtttgacagatttagagtctttgctgctgattcaagcagaatgaccccggatttaattttgtcggatgtggtttcttctggtgatgaattatgaagcgcatcaaaagtacgtatcacttttaagctgaatgccgggctgatccacattgcatatgcatagaccagctctttacagacatacgtcccaccattgcgcccctgaatggtgatgacaggaatactacgggaatctcccgtagtttcttcttccaataattccacaagagccttcgtttcaggacgacgcataaactcgtgaacttccagcgaacgggaggagcgattctcaccagcggcaagaagagcagctttctgaaggtcgttaagacagtagttagattcgaagtactggcgcacagaaacgccatcaattacaagcaactgattcattggtttctccacaaatttttatccacgagcgggactgcactcccttttcgttgatgcaggatgaacttactgcgatttttaatagttatcaaggatacactgttcataaatacagtatctttaacgaggtaatacccaaatttagggtgttgctcaattccgttaccgagttgctaatttgcaactcgctttttcgtacttactgatagtgatctcgaccttcccctccgggataaccggtccccactccaccagcattcttttcacctgactgtcgtcttcccacacacccgcgtgggtcagggcgtcaaacagcgccttgttatagttgtccagatcgcggatccggttatccggaggaaacaacacgatctccactgaagcaggtgccgacgttggtttcggcagacgacgtaactgctcaactattgctgcacacgccgcgctctggaattttcgccccgccgcgcttatcaggctcttaccagcaaacgcccctttgttggggtgtcgccagtacgtgttcacgctgggcggaaaaggcagtattagcttcatactttcaggcccctctcatgtaaccagtgggctgcacgcagcctggcgtttgcctcaccggcaagcagggcgcggataatcccgaccgcctcgctgtcgtcgtccttcaccgcggtatgaagagtgataccccgggccacgccacgctttatcgtgatgacaccttttttctccagtgcgcgaagatgctccaccgctgcattcaccgaacggtatcccagcatggttgccacctcctgattggttggcgggaagccacgttctttctgataagaaatcagcatatccagcacctgctgctggcattgagttaatgtcgtcatgccgccatctccctgaccagtttttccgcctgctggcgaacctgcgccagaaatgcctcaccacatgcctcaagttcatcgcgcccgatgtagctgattgccgctcccttccaggtcttgtcgaaaacagcaatagcaccagcgaagaaagcacctgttggcacctgcttttcgtctttcgggataaaccaggctggcagttcaaaaccaatacgcccgcgaataaaagcaatatgatctgcatcttccggccaccacacttcgctggtggccgctttgatcaggaaaacatagcgcccgcctttatcacgcatggcactggcatgcttcatgatgtaacgcatgccggtgatgtattgtccctcatgctgactggcgcggctgtacgggggattaccaaaggcagcacctttaagctccgcaagacgttctgaccagtcatgtgccagcgcgttgtcttccgccgtgtaatacgcggcacatttggcgttatcaccgtcagtaaacagatccagaacaaacgggccaaacagggtgttaattccccagaaaatgttgtccggcgtgcgccactgatcgcccacttccttcagttcatgggctggtttgttccgtagttccaccagcgcctggcaatatttattactcattaagcccccacgtaattccctgacagataccactcatcacccgctacagcgcgctttctgcttttccgtaagcaccgctcacgacgcgccagaaaattgtttcgttctggctgggagtggctttcacggaatgccgccatccacacggttgcagcacgacggtataagcccctggactccagttcttccgcctggcgggtcaggcacaaaatcacccggggatcgttagtgccgacatagaaattgcgcacaggtatggtttcaagaacaggttgcagtttctcctcctgcgatatctcagcctggtgtgggaaatgtctgcgtgttttcccttcacaacagtgagccacacggccactctgacgtaacttgcttgctgactgcagaacgcactgtcgtgagtaaccagcaaaagcatccgcaatgtcacctgaagtacaccccggatgggcttcaatgaatttctgtacatcgttcatcagactcatgatcaccccctgaatcctgtcgggatctggctgtagtccacgttgtcgtaactggctttgaagtacgggtcctcgcgtctggctgcagataccgcaggaacttcccaggattcttcgaaatgacgatccggaccaaagaacgtgacagcctgtttcacaaattgtgtgccgctattgcccatcgcagatacccagcccgcgtagcgtttcacaccttccagcatggtttcggggtttaccccctcgttcaaacgggctttccaggctttgaaggctgctgattttgaattgccaccagcacgtttgggatattcctgccaggcctgttcaaattccggtgaatattcctgtcgggcagaacgcgctggcgcagacgcgtcagcggatgcatcaatagtgtttttagtctccgttgtaatctctgtagtaatctctgtatttgtatcaacattcggcgtatcccctgttccgttatgacgtcggggggtgttccgttttaacgtaatagctgtatcgctgattgcattattgctgttactttctggcgaaacagaagaaggtgtggtgatggccgcaattgcctgtgggttgatcccgacaaacaaaatattgctgcatttcaccccatcgagcatttccaccgtgcgtaaatccagagtaataaaccctgcatcgcgcagacgcttcagcgcatctgcggtttcccttttcccgaaaccaaactgctcagcaaacgcctggtagcttctttgcagtttgtcgccctgaaaacgcttgcgatatcccagcaacgctccggtgtgctcatccctgacctctgtcgggcggtaccagtaaacgatctctgaaagcagagcgatagccgtcgcatccggacgcccactgggtagtcgaatatatttccaccaggtcgcaggtgtaacattgccggaaatattaatttgaccaatagccataacttccggtgtgggggcgtaacggctcatacaacctccttccgcagcatgagaattgtgtagccacgcgcaggttgtagtctggcttttgcatcaatagtaagcgttgcaatttttcggatatgaagataaccagctctttccagtgccagggtttccctgaatatcgcttgcttagaacaacagcagaaatcagcaagcacctgatgatcaataactctctcgccttcaccgtctgaagaacccgacatcaaaacacgcaacataatcaggcgctgaatcgggttatcgaaagcacatccgcacacaaactgaaaacagttcacgccacacctcccagacgcttaaacatttttccggagcaaaaggctataagcggcatactgacgcggtaattacggcccagcggttcacaaaccaccttctgacattcacggtcaaccaggctaacacgtagaacatgccctgcaggcgtggtgtaccactgaccaggacgaggacaacggaaagtctgattggtaaaccgtttgaaaatattccggatcatttgcgcccccttacctctgaagggttcagcgacaaatttatgagactggccagtagcgccgcgtcgttgatgcggtcatacagacttacagccagcggggattcggcttttgccaacatgggataaagctgctgcagccagacctgatgaattgatgaaatgtaggaatagagaacgctggcgttatgtgcaacgtcgctcagtacagagggatttgaaagctgtttctccatctggttaaaggcattgatgtatgcctctttgaactgggcagcacgtttacccgtgaaacccatagcaagaaacgcaaagccgtcgcgggttatttgatagcaaggtagtttgcgagtaccgccgttgggctggcgtaccaaaattgatgtctccgcaaaattgcgggcacaaaactctggagaacaatccaaaatgcggatctttttcagaacatcgtcatgacgtttagagaagaagtcagcaacagccaaagaagatgtaacagcctgaccatcaacgatggcaatttcaggttgagagagggttgggagagtagtcatagtgacagccccggtagtcagttttttagaaaactcaccacatgggacgccaatcacagaggtggtgagacgtacagggttggcgttaccggagactaccgaacccggcccgaccgaagtcggccctgtacgccccaccataatttgggcgtagcaatgctcatgacacgaaaaaaccgcatgagcgcggttatgctcagtaatcaatttcaggacgccaatcccggcacccgctttataaggtgcagagacagtgtaacgtcccgaaatggcagaatcaatatgctggtggtccttcacactcaacaaaatcacgcctgaatttccacaaaggactaaagcactcatgcgggtagtctttgcgaagatagataacgcgctgtgtttctggctcccaacgaataacatggacataaagccctcttccgtcacgaaaccagcggttaagttcctgcacaactcgccccccacagtcaggtaaagttctctgtggttacttacagccaggtgatttggtaatctgcattcatgccgtaacaacaggtgttcagcgacgctgaccaccagctgttgcgacaaacggttatttgccgttaaactattcatgcgttagtttctccacaaccagaagcaatcgacgccacgacgcccggagctgcacactcgcgggcgttactattttctggagcgcagaagattttgtagaccagtgctgcatgctcctggagcttcgaaattgagaggtacagctcgtcgttaattgctgtcttctcatgcggttccactacaccgtcttcgattgctgaacgaatctgtctggaataactgccgatctgttcaatgacttccagcagacgctggttaatatcggcgttgtccacatcctcgacgtcaggaagagacacaaagacgccatttgcagactgcgccacagcgtcagcaatgaagtgagttccaccagcacgttgtaaaatcattgcccatcccagcgggaaaatctgatcgccatcggcacgaaggcgattgaataaagcgttctctgttacatccagccactcagcagcttcagcgtaaccccccggcaacgccgcgatagtttttctgacagctttcacgtaccactcaggttgtttttccactttccaatgatgcttacccacggcttacctcctgttcctgtggtttaaacccattctggttttggctagattgaaaacgtgccggataaagaatctgcatttcgctgatttcacccttaaaaaaattggccagacgttctgcaaggtcgatagatggaatttgttccagtctttcaatacgactcagcgtcgctggattgacctgaacgcccgcagcaacatgctgcaaagtaaatccgtgcgccttacgcacattccgtaatggtgattgcatataacctccacatattgcgtgatgagcatattatttcacgcaaatattttgcgcaagttgatttgcttaacgcgcaataaagaaatgtaataaacgcatgaacataggaaatcgagtcagacaacttcgccaggcgaagaacatgaaaatcgccgatctcgctgaagcaataggagtggatgcggcgaatatctcgcgcctcgaaacaggtaagcagaaacaattcactgaacaagccctgagtaatattgccaggagcttaggtgttgatattgctgatctctttacctcagacctcaaaagtaatactgtatgtaaaaacagtattagtgaggatgttgcgcaggtgaaggatgtattccgtattgaaatgctggatgtcagtgccagtgcgggaaatggccttatccagggcggtgatgtcattgatgtgattcatgccattgaatacagaactgataatgctgtatcgatgtttggtggacgaccagcaaatcacattaaagttatcaacgttcgtggggacagtatgtgtccaaccattgagccaggagatctcatcttcgttgatatcagtatcaatcagtttgatggggatggtatatatgtatttggttttgatgataaaatttacgtcaaacgactgcaaatgatacctgataaactgctggtaatttctgataatcagatttaccgcgaatggggaattaccagcgaaaacgaacatcggtttatggtctttggaaaggtcttaatcagtcagtcacaaacccttaagcgacacaattaaccccctacctcaacatcaattagccaccagaaggtggcttttcattacccaccaaattgcatatctcgcaataaaaacacttgcataatgcgcaacttcattttatctttctttccagacctacaaacaaggtactaacaaaatttggttgtaacacggcgtatggcacatgcgtcgttagcggtctggggacgttaaaggggacaatccactccttgctcgggcaaacaaaccaggtagccggaatgtgcaagtcaatgaggatgctgataagacgcctaaccagcgtggcgattcggtttgacgcctgggaagagaccagggtgcaacgatgagggcatttatggaaccgcgacaaagtgtggtgccgtaactggctaagtgctctcagcgttgtggtgaatgcgcaggctgatgcgcgaaagacattgcagctattgcggaaaagagctgttcggcggggcaattaaacgcccgtgagagtctgaaataaccgcaagccggagatcagcaccggtcaccacaacagccactgctttggcggtaccagtttgtacacttgcttccggctggtaccgctctttttacaaaacagagaagagcatcaccggacgacgggctcataacccaatccatccgggcggctgccaccgcaggtgttcttctctgttttgtggagaaactaatacattgtgcagaggaaaatagaatgaaattaccaaaatttcgtaacgcaattgtgtaccgagcaacattacctagtatacaggctattgaaggtcatcttctcgaactcccttattctgaaatcggggaaacagaattttcacggtcctcttttgtagagaatcctgtcactggtgaactggtaactccgatatctggtgggtacgcaatggtaatccgtcatgatcagaaaataattccccgacatgtcgtcatgaaagaagctaattctcgaatccaaacaatcgaaaatatgtccgggaataaattaaagcgtgccgaacgactggccattattgataacgtacgagtagatctatgcaaacaggcatttgttaagtctactctgattcttgcattgtacagcactgatgagaaattattggtaatcaacacaaccaataaaataatagccggtatggtatgcgcaatgctgattaaggttgtcggttcagtgaaaacagaaacaatcaacatcagtgatatcaagaatggactgactacacgcctgaataactacatcaatggtgcagccaatgcatttgaaggattcactgtcggaaattatattcagctatcacgctacgcagatcaaaaggaaattattcgctactcagctgagcatgagtcaattcaaagcgaactggccgatagccttagtagtagtttcactgctgataaaatggagttatccggttgcggtgtgaccttcattcttaccgaaaatttccatttttcgcgcatcaatactcaatctcagacatttaatgatgaagatgataaagcattccagtggcgtcatcagactggcgctgaccttttccaattcagcaaggtagttaatttgatgtgtgaccttctttcttacaaagaagataaaagccaaaatccaacaacttaaaaaaattgcagcaatcatcccatgttaaatgggctggattgctgcaatcaaaattcagagcggtgcagcgcatataacgtggagaacaaaatgtcatttattaaaactttttccgggaagcatttttattatgacaagataaataaagacgacatcgtgattaacgatatcgcggtttccctttcaaatatctgccgctttgccggtcatctttctcacttctacagtgtcgcccaacatgcggtgctttgcagccagctggtgccgcaggaatttgcttttgaagcgttaatgcatgatgcaacagaagcgtattgccaggatattcccgctccactgaaacgccttcttcctgactataaacggatggaagaaaaaatagacgccgtaatccgtgagaaatacgggttacccccggttatgagcacgcctgtgaaatatgccgatctcatcatgctggcaaccgaacgccgcgatctcgggcttgatgatggctctttctggccagtactggaaggtatcccggcaacagaaatgttcaaagttattccactggctccgagccatgcctacgggatgtttatggagcgctttaacgagttatcggagttacgcacatgcgcatgaatgttttcgaaatggaagggtttcttcgcgggaaatgtgtaccacgagatctgaaagtgaatgaaacaaatgctgaatatctggtgcgtaaatttgctgaagcggaggccaagattttggctctgtccgaagaccaacagaaatcgattgagtcaattaagcaggctgatgcagctgttaagttggcacacgagaagttttcggcgctggcggcggagaatgcggggctgaaacacgcaatggccgtaactcttgagcatgtgtcggtcacggatgcagggcaggctggtgttgctgcaatgattatcaacgatgccctgcaccacagcgaaactccagccaccgatgctttcctggctgaaattcgtgcggaagcacgcaacgaggggattaactataccgcaagccgtcttgctgctgctttcaatcacggatttatcaataagtctttacgtgaagttttcgacgttacacgcatgattctgtcagcgaaagaagagttggctaatgaaccacacccgattgatggcctgtccggtgaatatgcggagaaatccctagaagaatgggcggaacagattcgcaaaggaggcaaccagtgagcggaaaaagaatgactaacagagagcttgttgatgccgcgattaagcttgctggtgatttttattcaatgatggggtacacgcatcgcccaggcttcaaatattgggagtctcctcacccgcaagagcaactggtatttcaaatggcctgccgtgcttttgaggttattcgcggttctgatgtgatggacgccgttgccgacttggaggatgaagagtgagcgagattaactatcaggcactgcgtgaaaaggcagagaaagcaactaaaggaagctacatcgtagggcatacatctgttaaccagcacggcaatttaacaggagtttttgtttgtcaaaaatggaaaggagaacccggtggcgtgattgcggaatgtcatgttaactgcctgattgaatcagatgctcaggcttatgcaaacgctgaattcatagcagaggctaacccggctaccgtgctggcactgctggatgaacgggaaagaaaccagcaatacatcaaacgccgcgaccaggagaacgaggaaattgcgctaacagtagggaagctgcgcgttgagcttgagcagacaaaatcaaaactcaacgagcagcgtgagtattacgaaggtgttatctcggatgggagtaagcgcatagcagaactggaggagcgggaaataaaaccagccaaaggcgaagttcttgtcgttgtatctggttttactggttgcgggaaaagcgccattgccggggaaatagaaatcgcgatgaaggctattggtgtaccggttcagtggactaatggcgatgcggaaaagcgcatgacaggagctgactggctgacagcgattgagatgtacaaaccaacagtgcgcatcgtggaagttaatgtgccacacgccgcgggcattcgtatcaaaggagagtgagatgagcgctataaccaaagaacgtatcgaattattcattaaaaatccgcttgataacggacttacccgtggcgaacaaatggaacttgcacggattgcgctggcatctctggaagccgaacctgtaagccaaacttacaacttgccagaattaatcgagggcatggaagtttccattgatgtaagcacttgtgatgctgatttaggtaatcgctatttcggcaccgtcaccgaggcgttagaacttgatactgccaagaatggttacatcctcctggttcaggacgcagagccaaacttcgatgtaaatggcaactctccgggaactccggatagttggataagctgtagtgagcggatgccagaaatgggagagcgacaatactatgtgttagcagctgactttaaaaacaactacccaccaaacatccccaacactcaggtcggcgtatatggcgactggtttaatgatggcaagcccacttgggatgacggtgatggcgaagacctgtatctcaaggaggtaacccactggatgccgctgccagaaccgccgcaggaggtgaatcaatgagctggcctgatgcaatcgtaactctgggggtggtattcgcagcagcgtttgttgtgttctcgatttgtcgatggggataaccacatgttcgctttgattcaacgcgggcagatatacaccgatagtgctggctacccgataaaaattgttcgctgcataaacaacactgtgttgtacagaagaatggatgggcgaacacagtcagtaaaaataaacgatttcaatgaactgtttgaacggattgatcaccaggaataccgacaaattctggcagaaacagagcaggaagctcatctgaaaaaattacgggccatgaaaaggaagtaaacaatgaataaagcatttgaacaatgggtccaccagcgttacggcaatcgctatgacctgacacgagatgttgacggtttctactgtcgtgaaattgtgaaacgaatgtttgaagtgtggtgccactgccgtgggctgagtgttgtgtgaggtaatgcatgggcaatgtgattcaactggctcccaatgaatgggtttgtgaaagcgttctaatcgcaattaccgggctcaaaccaggcacaattcttcgggcccggaaagaatgctggatggttggaagagagtatattcacgtatcaccagacggtaatccaaagccttccagtgaatgtatgtataacagaaaagcaatagatgcctgggtcgcttcaatgaaaaacaaacaacctgggtgatttaatgccatgaagtatgtaagctcgtatcgctcttgggcgtctggaggtatcaatggataaagtcaaatatccaacaggcgtcgaaaaccacggcggcacattacgcatctggtttaattttaaaggtaaacgtgtcagggaaaatcttggtgtccctgacactgccaagaacaggaagatcgccggggaactgcggacatcggtatgttttgccatccgcacaggaagctttgattatgctgcacagttccctgactcccccaaccttcaggcttttggggtaagtaaaaaagaaattacggtgaaggaacttgaagaaaagtggctggatctgaaacgaatggaaatctctgcaaatgcattcaatcgctatgaatccgttgcaagaacgatggtttcgaaaattggaggcagtagactggtgtcatcggtaaccaaagaggaattgctgtatatcaggaaagatttgctaaccgggtatcagaattcaacgaaaaacaaagcagcagcaaaaggacggagcgtcgttactgtaaattattacatgacgacaatcgctggaatgtttcagtttgctgcagatcacggttacttagaagcaaatcccttccagggaattaagcctcttaaaagagccagggcagagccagatccgctaactcgtgacgaatttattcgcctgatagatgcttgccgacatcagcagacgaaaaacctgtggtcattggctgtgtacacaggaatgcgtcacggtgaactggtctccctggcctgggaagatatcgatctgaaggcaggaacaattaccatcaggcgcaattatacgaaacttggtgagttcactctaccgaaaactgaagcaagcacaaacagggttgtgcaccttatccagcccgctatcagtgtcctgaaaaatcaggctgaaatgacaagactgggtaagcagtacaacatcaaggtgcaactacgtgaatatggacgttcagtgaaccatgaatgtactttcgtgtttaaccctcaagtggttagaaaaagcgaacaggtaggttttgtctacaaagtcgattctgtaggtgactcatgggaaacagccattaagcgtgcagggatcaggcatcgaaaggcataccagtcacgacacacttatgcgtgctggtcattatctgccggagcaaacccaagcttcattgccagccagatgggccatgcaagtgcccagatggtattcaatgtatacggagcatggatgactgacagcaatgcagaacagatcgcaatgctgaatcagaagctgacagattatgtcccaatgatgccccatagtcaccaaagtgacaccagaggcttattaaaatcagtaagttaatccttaatacccgtcatgttaactgtgtggagggtaacactacgctttatgccctgccgaaacccgaggttgtcctgcgctggcgtgagcagaccacagatgacttccgcttctgttttaagtttccggcgactatttcgcatcaggcagcattacggcattgcgatgatttagtgactgaatttttgacccgcatgtcaccgttggctccacgcattggacaatactggctgcaactgcctgccacattcggcccacgggagctgcctgcgctttggcattttctcgactctcttcccggcgaatttaattatggtgtggaagtccgccatccacagtttttcgccaaaggggaagaggaacaaacgcttaatcgcggtttacatcagcgcggcgttaatcgggtgattttagacagccgcccggttcatgcagcacgtccacacagtgaagctattcgcgacgctcaacgaaaaaaacctaaagttccggtacatgctgtactgacggcgacaaatccgctgatccgttttatcggtagtgatgatatgacgcaaaaccgggaattatttcaggtctggttacaaaaattagcgcagtggcgtcagaccactacgccttatctttttttacatacgccagatattgcccaggccccggaactggtacataccctgtgggaagacttacgtaaaacgcttccagagatcggagcagttccggctattccacagcaatcttctcttttctgaatttgccacctatcatagacaggtgccatcggccattttaaagggagtttgtatggtaagcgcgctgtatgccgttttaagtgcgttgttattaatgaagttctcttttgatgtcgttcgcctgcgaatgcagtaccgcgttgcctatggcgacggcggttttagcgaactgcaaagcgctattcgcattcatggtaacgcggtggaatatattcccatcgcgattgtgctgatgctgtttatggaaatgaatggcgcagaaacctggatggtgcatatttgcggcatcgttttgcttgctggtcgtctgatgcattattacggttttcatcaccgtctgttccgctggcgacgttccggcatgagcgccacctggtgtgcgctgttgctgatggtgctggcgaatctttggtatatgccctgggagttggttttctccctgcgttagcgcacaatacgccactttctttttcccggatttttacgttatgtctcaccgcgacacgctattttctgcccctatcgccagactgggcgactggacctttgatgaacgggtagctgaagtcttcccggatatgatccagcgttccgttcccggctattccaatattatttccatgattggtatgttagccgagcgcttcgttcaacctggtacgcaggtttacgatctgggttgttctctgggcgcggcgacgctctcggtgcgtcgcaacattcatcatgataattgcaaaattattgccatcgataactccccggcgatgattgaacgctgccgtcgtcatattgacgcctataaagctcctacgccagtagacgttattgaaggtgatattcgcgatatcgccattgaaaatgcatcgatggtggtgctgaattttaccctgcaattcctggaaccttccgagcgccaggcgttactggataaaatttatcaaggactgaacccgggcggtgcgctggtgctttcggaaaaattcagtttcgaagatgccaaagttggtgaactgctgttcaacatgcaccacgactttaaacgtgccaacggttacagcgaactggagatcagccagaaacgcagcatgctggaaaacgtgatgctgaccgattccgtggaaacccataaagcacgcctgcataaagccggttttgagcatagcgagctgtggttccagtgctttaactttggttcactggtggcattaaaagcagaggacgctgcatgatcgactttggtaacttttattctctgattgccaaaaatcatctttcacactggctggaaacgctgcccgcgcagattgctaactggcagcgcgagcagcagcacgggttgtttaaacagtggtccaacgcggtggaatttctgcctgaaattaaaccgtatcatcttgatttattgcatagcgtgacggcagaaagcgaagagccactgagcgcagggcaaattaaacgcattgaaacgctgatgcgcaacctgatgccgtggcgcaaagggccgttctcactgtatggcgtcaacatcgataccgaatggcgttccgactggaaatgggatcgcgttctgccccatctttctgatttaaccgggcgcaccattcttgatgtcggctgcgggagcggttatcacatgtggcgcatgattggcgcaggcgcgcacctcgcggtgggaatcgaccctacgcaactgtttctgtgccagtttgaagcggtgcgtaaactactgggtaacgatcagcgcgcacatttgttaccgttaggtattgaacaacttccggcactgaaagcctttgataccgtcttttcgatgggcgtgctttatcatcgtcgttcaccgctggagcatctctggcagttaaaagaccaactggtgaatgaaggtgaactagtgcttgaaacgctggttattgatggtgatgagaacacggtgctggtgccgggcgatcgttacgcacaaatgcgtaatgtctatttcattccttccgcgctggcgctgaaaaactggctgaagaagtgtggttttgttgacattcgcattgcggatgtgagcgttaccaccacagaagagcagcgacgcaccgaatggatggtcaccgagtctctggccgattttctcgacccgcatgatccgggtaagacggtggaaggttatcctgcgcctaaacgcgcggtgctgattgcgcgcaagccgtaaaaatttagcgcccgtttccgggcgcttttcacgtcttatgcctgaacagctggctgatcaaacgccgttaacttcggtgcattgcccgtatatttttcgatatacaccagcgcagagttaccggcacaggcatttgccagctgagagctggggatatccgccgttaacacgttcgcactaccgtttttacacaagccattttccagatccggccatgcaccttcatgcacgcataccacgccttttttgatcccgtcagtcaccacagcgcctgtcaagatctgaccgcgcttgttccagacacgcaccagatcgccattcgcaataccaaagcgagcagcatcttcggtgtgaatagtgatcggttcacgatcggcagccgcatattttttacgcagttccgcatagttaagctgactgtgtaaacggtgtgccggatgtgcggtcagaagctgcaactgcttctcgtcggcggtacccttccactcatcaggcgcaagccaggttgggtgtgccgggcaatccttatagccaaatttttccagcgttttggagtaaatctcaattttgccgcttggcgtacccagcgcatttttcaccggatcggcgcggaaatcaccataacgaacgtactgttcgttcttctcgctgcggcgcatttcgatcagtttattttgctgccagaaggcattaaacatcggcatcgtcacgcgttgcgcacgggcacctttctgagcggcatcatagaaaaatttcagccacgccatctcatctttaccttcggtatagatctcttttccgccaggtttcagtaattcagcaagatcggcaaacacgtcaaaatcgttacgcgcttcaaattgcggagcgacagcctgcttcatcggtacaatatgctggttgctgtaatcaccggtcatcgtcaagtcattgcgctcaaacgatgtggtgatcggtaatacgatatctgcatgtttagcagctgcggtccagtagcattcagaaacgacgatcatctccggtttctgccatgctttaatcagacgattagtatcctggtgatgggtaaagttaccgccacccgcccaccagatcattttgatattcggatacgtttgttctttaccgttatgctgatatttgccgccaggattttccagcgcatcgacgatacgggcaacaggaatcgccgtcattccgccatcatcagcggcctcgctggcctgtccggcaatcgccgcagacatttccggcagcacgccgccaacacgcgtcgggttgccaccattggagtaatgataagagaaaccaaaaccgccgcccggtgtaccaatctgccctaacatcgccgccagcgtcaccagcatccagtgtttctgttcaccatattgctggcgctgaattccccagcctgccatcagcattgtgcgattcgccgccatcagttcagcgagtttgactatctgcgcttccggtacgccagtaatttccgccgcccaggccgcgctcttcggcgtattatcgctcttacctgtcagatactcttcaaactgcgggtagccggtggtgtatttttccaggaaggccttatcgtgcttaccttgtaccatcaaggtgtgcgcaatccctaacatcaacgccacgtcggtacccatatttggggcgatccaggtggcgttatcgccaaagaagtcgatggtttcggagcggataggatcaatggcaatcacgggtttgccagattttttcagctgatggaagtattccagcccttgctcatcggtactgctccaggcaattttcaaggtattcagcgggttcatcccccacagcaccaccacctggctgttttccagaatcagcggccaggaggtctgctgttcatacacctctacagaaccgaccacatgcggcatgatcacctgtgctgccccggttgaataatcgccgctatgcccggaataaccgcccgccaggttcatataacgttgcagtaaggtttgcgctttatgcaacacgccagaagagcgccagccgtaagatccggcaaaaatggccgatggtccgttagctttacgaatacgatcgtgttgctcatgaatcagttttaatgcttgttcccagctcacctgtacataggtatcttcgccacgacctttcaccggttgcagtggattatcgagatagctttttctcaccatcggatgctgaatacgcgccgtggtgtgtacctgatccgccgccgtagactgtaaggagttcggtatggttttcgccagcgcgcctgtcgaagaaacaatcttgccgtccttcacttctacgttcatcgctccccaacggcccgcagtgagaattttgccccccttctcttctgcccatgcaggtaacggtgcagccgatgtcaccaccagcgcccctgccgcaataccgctatgtttaataaattcacgtcttgttaatgtcataacttcctccctgatcaacgaggatcactgtttctcggtaatatctttggcgttgtactggaagtaccgcgtcaaaatgtccagttcgttttcgctcatgctggttcgcgcacccattcctttggcaatggacggccatgtattgacggtgtaatggtcggcggcaataggggcatggcagccagcgcaataggtatcgtcaagtttttcagcgtattgccatagcggtttacggtccgctaatgcgggatcggtaagcgcaccctgtaaagacgcctgacgccattgattgccgtattcgtcagcctgccattccccgtttaccgttagcgccttgataccttcttcacttaatgtggctagcgccagccgttgacctgccgccaggtagagcgtgttttcactaccctgcatttgataaccctgcaaccgaacaattggctgtttgccactggcatcaacgacggtgagatcggtaccaggagtcacggtagccaagtcgcctatgcgagaagttttgaaaggataaatatgtgcgccattagtcactgaagtagcggcctgactttccagctcatgcgccgcgttgtcatccatttttatttctggcgggaaatgggcaatgcctttatggcaatcgatacacgtttcaacgtccttttgcgctttattatgcattttctgcgcagattcactttgcgaggcaatatccatggcatcaaaagaatggcaactacggcaggttgcagagtcagttgcttttaattctttccatactgtttcggccatttcctggcgatgagcttcgaacttatcgtcactgtctattttgccgctaacaaattcatgataaatatctttagatgcttttaatttagcaaataaataatccatccctgactttggaatatggtaatcggcacattccgcacgtatccctttctggtttgaaaagtggacagttccctgatattcctcaaaaggtttactcatcgagtggcaggaaaggcaaaatgcggtatccgacgttttatgtaaggctttttgcgccagcaataacccgccgccaccaaccacaaccgctatcagcagaaacaataacccaatgcgtttttttcctcgcatagattcctctaattaaattccaggacaccgacaccattgtataaataaatatacaacgaattgactacttgcttaattcggcacaacactgcctgaaataatcgataaagaatatgatttattacaatgtaatcattaattgctaaggaataacccagttgttatttagaatatatatttgtcagttttggcaatttaaatcacataatgaatgtgaatatataaaatatttttagcacaacgctatgcgcactgtcacccgctcaacagatcacggtaatcgttcgttttttatactgcccagggataaaaaaaggcccctgttgaaattgcaggggcctggtacgagcaagcatcatattgggcgacatgatgcaacggtaaaaatcatttggcctgatggcattcaatgattcctttcatttcagcaaccgccgccccgtctacgacataacgcgaatactcgtccgcgtgtgcatctgatgacatggacaatccttgattacgataacgcatcggtgaggcttgccacgctcccgcggagctatggacttccagcactccggcatcgaggaagtggtgcaggttttccgcacggactcctgctccggccataatgattggagcatcacgatgggcaataagttccataatttttgataaaccttgcagcgcgtctgatttttgccctgatgtcagtacccgggtaatgcccaattccgcaagattattgagtgtatttaaagggttagcgcacatatcgaaggcgcgatgaaaagtcactgccagcggaccggcagcagccattattttttccattcgtggcatatcgacattcccgtcaacctcgagaacgcccgtcaccagtccaggaaaacctaattcgcggactgtgcgcacatcttcaagaatggcggcaaactcaccgtcgctgtagcaaaaatcaccaccgcgtgggcggataatcggatgcactgggatcgtcacccgctggcgcacggatttcagtacccccaacgacggcgttaagcccccctcttttggagctgcgcataattcaactctgtcagcgccgttttgctgcgccgttagcgcgcattccatgctgtaacagcaaatttccagtaatgccatttttgctccttagttacgccgactgctcgctggcaacgatctcttcaatggaccacggatgaaacttaatggttgttttaccatcggtgaccgccagcgtcggattcggtaatcgttcatgctcaccttttggcgaactggttttaactgagatccccggcaggctgagtccttcatcagaaagcaatgccagcgcacgggcattcagcgtttctggatcacccggcagaacgatttcaatatgttcccaaccttcgtgcgggtaacgtttttccccgggccatggtagctccacaatggaaaactgccagtgcgcaacctgtaccggttcatgcaatttaaacagacaaatcggtctgccattgatcatattttctgacaaaagctcgccgcactgttcaaacccgcgacgccagcgttcagcggtgacgttttgatggcaacgcaaggaaatgtgatcggcagtcagcggagtgatatccaaccccagacggcgggaaagttcatctaatgcgtgggtaaatcgcggtaaatccgatgcaatatcctgcagctcgtcgatagattgccagttcgccataatcactcttcgtctttcattaaaagcgttaatttaccctgttgccctgcgccaaccaaccgctgatttcacgccgcttctgatgcaatagtgaaaacggcaatacgccacgcgcacgttgctgacgaaaacagccatttgcagtatactcccgccctaatttctttaactggtgcgggcaatttttgctcgcttcatcaatgtaaggtattccggtgaatattcaggctcttctctcagaaaaagtccgtcaggccatgattgcggcaggcgcgcctgcggattgcgaaccgcaggttcgtcagtcagcaaaagttcagttcggcgactatcaggctaacggcatgatggcagttgctaaaaaactgggtatggcaccgcgacaattagcagagcaggtgctgactcatctggatcttaacggtatcgccagcaaagttgagatcgccggtccaggctttatcaacattttccttgatccggcattcctggctgaacatgttcagcaggcgctggcgtccgatcgtctcggtgttgctacgccagaaaaacagaccattgtggttgactactctgcgccaaacgtggcgaaagagatgcatgtcggtcacctgcgctctaccattattggtgacgcagcagttcgtactctggagttcctcggtcacaaagtgattcgcgcaaaccacgtcggcgactggggcactcagttcggtatgctgattgcatggctggaaaagcagcagcaggaaaacgccggtgaaatggagctggctgaccttgaaggtttctaccgcgatgcgaaaaagcattacgacgaggatgaagagtttgccgagcgtgcacgtaactacgtggtaaaactgcaaagcggtgacgaatatttccacgagatgtggcgcaaactggtcgacatcaccatgacgcagaaccagatcacctacgatcgtctgaacgtgacgttgacccgcgatgacgtcatgggtgaaagtctctacaacccaatgctgccgggtatcgtggcggacctgaaagccaaaggtctggcagtagaaagtgaaggcgcgaccgttgtattccttgatgagttcaaaaacaaggaaggcgaaccgatgggcgttatcattcagaagaaagatggcggctatctctacaccaccactgatatcgcctgtgcgaaatatcgttatgaaacactgcatgccgatcgcgtgctgtattacatcgattcccgtcagcatcaacacctgatgcaggcatgggcgatcgtccgtaaagcgggctatgtaccggaatccgtaccgctggaacaccacatgttcggcatgatgctgggcaaagatggtaaaccgttcaaaacccgcgctggcggtacggtgaaactggccgatctgctggatgaagccctggagcgtgcacgtcgtctggtggcagaaaagaacccggatatgccagccgacgagctggaaaaactggctaacgcggttggtattggtgcggtgaaatatgcggatctctccaaaaaccgcaccacggactacatcttcgactgggacaacatgctggcgtttgagggtaataccgcgccatacatgcagtatgcttacacgcgtgtattgtccgtgttccgtaaagcagaaattaacgaagagcaactggctgcagctccggtaatcatccgtgaagatcgtgaagcgcaactggcagctcgcctgctgcagtttgaagaaaccctcactgtggttgcccgtgaaggcacgccgcatgtgatgtgtgcttacctgtacgatctggccggtctgttctctggcttctacgagcactgcccgatcctcagcgcagaaaacgaagaagtgcgtaacagccgtctgaaactggcacaactgacggcgaagacgctgaagctgggtctggatacgctgggtattgagacagtagagcgtatgtaatcgcgttatacggcaacagccgatgtcattgcagacatcggcttttttatcattaacgataatttacaatcacttcattccgctgaatctttagcggcggaattaaccgcccaccgccaggcacttcccagataaatcgcaacggttctgccgccggtataccggaaaaggccacggtggttccactctgcccctctaattcgacacaacgagattgtgaacacaagcgaacccgcagtcctgcaggtgtcggaccgataagctgataacgccacgccaccagcgtcatcaatcctgaagcaggttgtcgcgtagaaagaggcgctgacgacatcgattcaccgcgatgatttagcgtaacgcccacgctactcgcctgccacatcccctccccggcggcttgcactagcagcggaaacaataatattgctaataaggctctcattatttgccgccaatcgtcgccgtcatacggatatgtcggttatctgatagttccagattcgacagcaccactaactgcggcaagctgcggcgcaggaagcgagacaataatggtcgcagcgcgtggttcaccaacagtaccggcggcgcacccaacatctcctgacgggatagcgcttcctgagtttgcgccagtaaacgatccgccagccctggctccagtccccccccaccctgcaacgcctgtagcaacaaacgttccagcggtgtatcgaggccaataacatggacttcatctttgccaggaaaccactgctgggtaatcgcacgtcccaacgccacgcgcacgacagcggttaattcatgcggatcgctctggatgggcgcatgttccgccagcgtttcgagaatagtgcgcatatcgcgaatcggcactttttcatcgagcagattttgcagcactttatgcagtgtggtgagcgtgacgacgccaggaacgagatcttccgtcagctttggcatctcctgggcgacgcgatccagcaactgttgcgcctcctgacgaccaaacagctctgcggcatgctggctaatgaggtggttaagatgcgttgccaccaccgtgctggcctcaaccacggtgtacccctgaatctgcgcctgttctttaagcgcactttcaatccagatagcattcaggccaaatgccggatcgacggtcgcctcaccaggtaacgtcccggcagcggtaccagggttaatcgccaaccaacgccccggataagcatcaccactgcctatctccacgcctttcatcaaaatgcgatagcgggcaggttgcagatccatattgtcgcgaatgtgcaccaccggcggcagaaaccccatctcctgggcaaatttcttgcgaatactgcgtatacggcccagcaactcaccatcctgctggaaatcgaccatcgggatcaggcgataacccacttccattcccagagaatcttccagttgtacatcgttccacgtcgcttcgacaacggtattattctctgccatttttaccggtttgggttcggcaggcgctttttgttcacgtccgcggatccaccaggccagtcccagcaatccggcagtgaacagcaaaaataccaggttcggcattccaggcaccaggccgagtaaaccgagcacggcggcgcttaataacataacgcttgggttactgaaaagctgattcaccatctgctcgccaacatcctgatcggtgctgacacgtgtaacgatgacgcccgcggcggtagaaatcaccagtgccgggatttgtgccaccagaccgtcgccaatggtcaatagcgtataactttccgccgcgtgccccatgctcatgccatgttgcagcacaccgaccagcaatccgccgacaacgttaatgaccatgatgaggatcccggcgatggcatcgccgcgaacaaacttacttgccccgtccatcgagccgtaaaaatcggcttcctgagtcacttcggagcggcgttttttcgcttcatcttcaccaatcaatccagcgttaaggtcggcgtcaatcgccatctgcttacccggcataccatcgagaacaaagcgcgcgcccacttccgcaatacgcccggcacctttggtgataaccataaagttgatgatcacgagaatgacgaacaccacgataccgatagcgaaattgccaccaacgaggaagtgaccgaacgcttcgaccacctttccagccgccgccgcgccggtatgcccttccatcaaaatgatacgggttgaagccacgttaagtgccagacgcaacagcgtggtaaacaacaggatggtcggaaacgcagcaaactcgagcgtgcgctgggtaaacatcgccaccagcaacaccatgatcgacaaagcaatattgaaggtaaacagcaggtcgagtatgaatgcgggcagtggcagtaccatcatcgacaagatcaacaggatcaaaatcggtccggcaaggatctgccattgtgtcgatttcaggtttgcaggcaggcgcagcatcgcggccagattactcatgggtcggtttctcgttaataaaatccagggcttccggcaccggaagatgagtaggttgtacagggcgttgtccaccagccagacgccagcgtttcagttgccagacccaggccagcacttccgccaccgcggcgtacagttgacccgggatttgttgaccgatctccgcatgtcgatacagcgcacgcgccagcggcggcgcttcaagcgtcgggacgttattttcagcgccaatttcacgaatgcgcagcgcgaccagccctgcacctttagcgaccactttcggtgcgctcattttgttttcgtcatactgcaacgctaccgaatagtgggtcgggttattgacaatgacatccgctttcggcacatcggccatcatccgacgccgtgcggccgctcgctgcatctgacggatccgccctttaacatgggggtcgccttcgctttgtttgaactcatcacgaatatcctgccgtgacattcgcagctttttcaggtggctgaagatttggaaaaagacgtcaaatcccaccattggaatgacaccaagcaccaccagcagcgcgcatagccctaccagatccatcgcattacccatggcggtaatcggagactcggccattaagcgcatcatctgcggccagtgatgccagagaaaaaaccccgtcacgctgccaaccaggatggttttcaaaattgccttaagcaactccgcgccagtctgtgccgagaatatccgtttaatgcccggtagcgggttgagtttggaaaacttcggctgcaaggatttgccgctaaataccagccctcccagcatgaccggagaaatgagcgccaccagcaccacgccgctaatcagcggtaacagcgccagcatggcttctctgatcagcagaataatttgcccgaggatcagattcgggtcattgataatactgtgatcaaaatgcagcccagcggagagcatgcccgacaatcgacgggccagcgacacaccgccaaaccagataacacacacgcccactaacaaaatcagcagtgaagtcagttcacgggaacgcgggatttgcccctcttcccgcgctttttctagtcggtgaggtgtgggggcttctgttttgtcgtcgctctcgtcagacacgtcgccaatcctggaaagagtattaagcgtaaatgatgccagagcgcaaagcgttcaatggtttgagtaaggggcaaaacaggcgggatttagggcttttgctgccacacatcaagcatagtatgcgtttgtcggatgcggcgtcatcgcctgatatgacgtggtcacgccacatcaggcaatacaaatcaaaatccgagactatccaacaaatcgtccacctgatcctgactggctaccacaccggctttgctggtatcgacctgaggtccattaagcaaactctggttttcacgttttggacgcgactcctgttccgggatgttttccaacagcaccatcaacaactggcgttcgatctcctgaatgacatccatcatccgcttaatgacctgtccggtgagatcctgaaaatcctgcgccatcatgatttccagcagttgcgcgttagtaaagctggtatgcgcggggacatctgccagaaattgccgcgtatctgttaccagttctcgggcgtcggcaaggtcaatcggatcggcaaaccagtcatcccaacgttgggttaacgcttttgctgatttctccatttgatcctgatgcggttgtgacgcctcaacactgttcagcgcccgctccgcagcctgggcggtcatctgcacaacatagtacaaacgatcgcgcgcatcggggatggcttccgccgcttcggcaatggcctgatccagccccagctcccgcaaactgtcgcgcagcatacgcgtcaggctgccgatgcgcgcaatgatatcgccagctgaatgctcgtcagcaggtttgattgatggttgcatcatagtcgcatcctcacatgcccagtttctcaaagattttgttgagtttttcctccagcgtcgcggcggtaaatggcttcaccacatagccactggcccccgcttgcgccgcagcaatgatgttctctttcttcgcttctgcagtcaccattaacactggcaatgccgacatcgcgccatccgcacgaatcgttttcagcaattccaggccatccatattgggcatgttccagtcggagataacaaatccataaccgcctgcctgcaacttattgagagcgtcgaggccatcttccgcttcctcaacattattgaatcccagctctttcagcaggttacgcactatgcgtcgcatggtggaaaagtcatccacaaccaaaaatttaagttctttatccgccatttcacactcctgatttaaatacgtatcgcctgtccggcactaatttttgccagcatttgctgacttacctggctaagatcgaccacttcgcagacaccacccatattgatggcctcgcgcggcatgccgaacaccacgcaacttgcttcgttttgcgcaagggtccatgcccccgcctgacgcatcgccaacattcccgccgcgccgtcgttgcccataccggttaggatcaccccaaccgcattacgccccgcctgtttggccacagaatggaacaacacatctaccgatggccgatggcgattaaccgccgggccatcgtgaattttgatttgataatttgcgccactacgcgccagctccatatgccgatcgcccggcgcgatataggcatgtcccggcaagacgcgctctccgtcttcggcttctttaaccccgatctggcaaagcttattaagtctgtcggcaaaagagcgggtgaaaccgggcggcatatgctgggtaattaacagtgccggactggaaagcggcaacggttgcagtacgtgacgaattgcctcagttccacccgttgaagcaccaatcgcaatcagtttttcagaactcaacaacggccccgccttcagcgttgtcggtaccgacaatggcttatgtgctgcaaggctcgcctttgctgccgtacgcaccttttcagcaatcatttcgctatacgccagcattccttcgcgaatacccagttgcggtttggtgacaaaatctatcgcccccagctccagcgcgcgcagcgtgacttctgaccctttgccggtcagggaagaaaccatcacaacgggcattggacgcaaacgcattaatttttcgaggaaatccagtccgtccatccgcggcatttcaacatccagcgtcaatacatcgggattgaatttcttaatcaaatcacgcgcaaccagcggatcaggggcggtcgccaccatttccatgtcgctatggctgttgatgatttctgtcatgatctggcgcatcagtgccgaatcatcgacagataacaccctgattttgctcatcgttaatccttacttagcgcatacaccgtctgaccacgcagcgtgaagcggcgctcaaggtggctaaagttttcagagtgacccgcaaacagcaatccgtcgggtttaaggagcggaacaaagcggcgcaaaatcttctgctgggtagtttgatcgaagtagatcatgacgttacgacagaagatcgcatcaaacggccccggcacggtgtactgtttcgccagtaaattcagcggggcaaaatcaacatagttcgccagctcctgacgcacgcgtaccagcccttcatgcggtcccgtccctcgcatgaaataccgttgcagttgctgcggcgtcaggtttttcaactcttcatggcgataaataccgcttctggctttttccagcacttcggtgtcgatatcgctggcaaacactttccagcgtccgggcgcggtgcccaatgtatcagccagcgtcatcgctatgctgtacggctcttcgccggttgaagccgccgcgctccatacgcgatactcgccagaacggcgacgtgcgtgatccgcgagcagaggaaaatggtgtgcctcacggaaaaatgccgtcagattcgtggtcagcgaattgataaacgcctgccactcaccgctgtgctgattagattccagcaagttcaggtaatgaccgaaatccgccagtcccagcgcacgcaaacgacgaaccagtcggttgtaaaccatgtcgcgtttatggtcagccagaacgatcccggctcgttgatagatcaattgacttatccgccgaaaatgcgcgtcggaaagcgccaggcgctcggtcatctgtaacaataaagacgtttgcccacagggcagagatgaagtcatagcgccttctcaatcacttcaggataccactggcgcaatttgtaactacgccgactcatgtcgtgctacttcatgttcttcaagggtaaataccgccacacgcgacgaaagatggtcggcctgattcagtcgttgcaaatcgtcgcgaaatgcccaaaagacatgccgttactgccaatctgcaagatcccgcagagaatcaaaattaaaaacagcgtggtcgaaattcgaatacgattaaacatcaacgctccccatcaggcggcaatgaccgctttagtaaatactcgtcaaaatgtttcccagtttggatcttgttcagcaattcgcagtcgtggctgtgccggtggttgctcactggcaggacgggatggtgtttgcggtttattggtgagtgggctggctgccagacggaacgcggaaaccgcttgcgttaaacgactcgcctgttcttccagcgcagctgcggcggcagctgattcctgcaccagcgatgcgttctgttgcgtgacgcgatccatttccgaaaccgccaatgcgacttgatcgatgccacggctctgttcatccgatgctgatgcaatctcgcccataatgtcagtcacgcgagtgacagcattgacgatattgttcattgtttccccagcgctttcgaccagcaccgaaccggtatcaacgcgcgagacggagtcttcaatgagggctttgatctcttttgccgcctgtgcactgcgactggcaagattacgcacttcacccgccaccacggcaaaaccacggccctgttcacccgctcgcgcggcttcaacagcggcattcagcgcgaggatattagtctggaaggcaataccatcgataacgctgataatgtcggcaattttcttcgaactatcggcgatctcatgcatcgttttcactacgccatccaccactttgccgccgtgctgggcggtgtcggaggcactttgcgccagttgcgaggcctggcgggcgttatcggcgttttgcttcactgtcgcggtgagctgctccatgctggcggcagtttcttccagcgcggatgcctgctgttcagtacgggaggaaagatcggtgttgcccgccgcaatttcacgggtaccggcatagatggcatctgaaccttcgcgcacatgagtgacggtgtcagtcaaagagcgttgcatatgtgaaacgctctgcgccaggtcgcccatttcactgcgcccgtcaatggtcagggtattcgccaggttaccaccggcaatttcgcgaatatgcgcaataatttttgccagcggtgtaagcaacatacggcgaatgccgtaccacgccaccagcagaatcaataccaccaccagcgcgataaccgccagttgccactgggcaaatcggtaatcatctgcgttgtcagtgacgatatcgcgatacagtttttcactgctgagggcgtactgagcaaacgcttcgcccattgcattttgcattccctgggttggctgagcgaaataagctccagtattgccataatcaagataatcaatcagttcagttaacgctgtgtgatagtttttatatttttcatcaatattacgactggtagcgaccatttcaggtaacggtgccatgcttttgaattttttataatgagtcgcggcctgggccaatgttttcctggcactatcgagcaactcaactttggcattactttgctgattggatgaatccatcatcatccgcaccgctgaacgactcaggttaatgcgcgtttgtagcattaaatcccatgttgacgtcagctcgccctgctgttcccgtaattgattggaaaccacaaagctcttctggctatggtgaagggaagaaaaaaacagactgccggaaataagctgtaacagtgcgaatacccccagcaccattaccaacagcgtgactacgcggatacggttaatcataaggcaccttcctgaaaacatgttgatctcgttatcggcaaggaggggggaaactttattgctgatgccacccgccgcgaaattgaaataaaaaacccgatgcgcagatcatcgggttcatttcaattgaggaaatcgggagaattacgccacttctgacgccgcgctatctaacagcgccatctcttcgctgttcagcagtttttcgatgttcaccagaatcaacatgcagtcgcccagtgcgcccagtcctgtgagatattcggttgaaagcgtcacggcaaattccggtgccggacgaatttgctccgccgtcaatgaaagcacgtctgagacgccgtcaaccacgatgccgaccacccgctgtccgagattcaggacgataactaccgtgttgtcgttatagtccacatccacctggctgaacttaattcgtaagtcaacaatcggcacaataacgccgcgcagattcgtgacgcctttgataaacgctggcgtgttcgcaatccgtgtcacctgatcgtagccacggatctcctgcactttcagaatatcaataccgtactcttcaccaccaagggtaaataccagaaattcctggcctgacggctcgctggccagctttgttacattcgtcataccggtcatattgttacctttttactcattcaggcggcggtgttcgccatacgttgttcgcggtttatcgcctgcaaggcggagacatcaacaatcagtgccacgctgccgtcgccaagaatggtcgcagcagaaatgccggggactttgcgatagttactttcaaggtttttaaccacaacctggtgttgaccaattaattgatccaccagcaagacgtagcggcgaccgccactttgtaagatcaccacaattccctgggtggcttcggttttcgcgcccgcgacgttgaacactttccacagttcgacgataggcagatattcaccccgcacttccagcacccgctcgccgccagccagtggatgcagatcggcttcacggggttgcagtgattccatgacagcattcagcggcagaatgaaaacttcatccgcaacgcgtacggacatgccgtcaagaattgccagcgtcagcggcagtaaaatgcggatcgtagtgccagtaccctgcatcgactggatctcgacatgaccgcccatctcctggatattacgtttaacgacgtccatgccgacgccacgcccggagacgtcggtgacctgctctgccgtggagaagccaggtgcaaatatcagcattgcaacttcgtcgtcgctcatgttttcgctgacggtcagaccttgcgaggccgcttttgccagaattcgctcacggtttagccccgccccatcgtcggtcacttcaatgcaaatgttgccgccctgatgttcggcagacagaattaaatttccgacgctgtttttacctgcggcgagccgtttttctggcagttcaataccgtgatcgaggctattgcgtaccaggtgggtcagcgggtcgataatgcgttcaatcaggctcttgtcgagttcagtagaactgcccaccagcgtcagttctacctgcttgccgagttttcccgccagatcacgcaccagccggggatagcgactaaagacatattccatcggcatcatgcgaatcgacatcactgattcctgcaaatcacgagcgttacgttgtaactgccccatgctggtaatcaaatcaccatgattaaccgggtccagttcactggagcgctgagcaagcatggactgggtgatgaccagctcgccgacgaggttaattaattgatcaaccttttctaccgctacacggatgctggtggattcactgctgcgcgtcgttttttcccgctccacgcgaccggttggcgcttgttcggctgccagtttaagcactggtggggtggatatttttggcgagacgtctactgtttcaaaggtaatctgatcggcttcaatcacaaaacagagtaccgctgtgatgtcatcttcggcgatgtcgcccggtaatattgccgagagagaatccgcccctttcaccacgtcagttaacgttgtcagatgccccaactcttcttccagcaggtcgacttcgccggccttcaggcgcgaaaggataattcgtcgcggtgactgactacgactctgctcatcttgcggttcacttttggcaaccacacttaatcgggtcactgcggatggcgtttcgcctttcgcttctaatgccagttgacgcaaggcctggcagatataatcgaagctggcggcatccggctcttgcgactgtttataagcgtcgagctgttcttgcatgatgtccttcgtttccaaaaacagattgataatgtcggtgttgagttgcatctcacctcgtctggcttcatcgagcaggttttccatcagatgcgtggtttcctgcaaaacgctgaagccaaaggttcctgcccctcctttgatcgagtgggcagcccgaaagatggcattcaactgttcggcatctggcgcttccggctgcaaaaccagcagatgctgctccatatcagccaacagttcgtccgcttcatcaaaaaatgtctgataaaaatcgcttatatccatgctcacgctgtcacctcggttcggctgatggcattgtgggaacactgacctgtggtgcaacctcaggtttttccagggcgcttactggctcattctggctttcggcgttttcatgcaaaatggcctgttcggcgtgtttgttcagtaccagcaggctgatgcgacggttgacggcatcatcaggtccgcgatcgcttaagcgcatcgttgccgccatgccgacgacacgtaacactttgccgccattcaacccaccaaccatcagttcgcggcgggatgcattggcacgatcggcagaaagctcccagttgctgtaacctttctcaccgctggcgtagggaaaatcatcggtatgacccgagaggctaattcggttgggaataccgttcagtacgggcgcgatggcgcgcagaatgtcgcgcatatagggttcgacgtcggcactgccggttctgaacatcgggcgattctggctatcgatgatctgaatacgtagaccttcctggaccagatcgattttgagatgtggacgtaacgcccgcagtttcggatcggactcaatcaactggtcgagatcgccacgcaatttccgcaatcgactttgctccatgcgttttttcagctcttcgatgttcggctgcttattcacttccccctggctttgggtgtaatcatcacccccaccgggaattgggctttcactattagaaatgcgatcgccgcccgtaaccgctgtcgccagcggagtccggaagtactccgcaatctgaatcagctcttttggactggagatagagatcagccacatcaccagaaaaaaggccatcattgcggtcataaagtcggcataagcaatcttccacgatccatgggctgctccgtggcttttggctttgcgtcgtttgacgacaataatcggatgcgcttgattcttcatgcttcctcggttgtcgtctgttgttgcggatttttcaccgcacgcacatgctcttccagctcaataaacgacggacgttcgctggaatagagcgttttgcgaccaaactcaacggcgataggcggtgcgtaaccgttcagattagaaagcagagtgactttgacgcactgcatcattttgctggtttcggcgcttttctgacgtaaaacactcgctaatggggaaataaatccgtaagccaataaaataccgaggaaagtccccaccatcgcatgagcgataagcgcccccagctcggcggcaggacgatcggctgaacctaacgcgtgaacgacccccattacagccgcaacaataccaaacgccggaagtgagtccccgaccagcgccagactgttcgccgggacttctgcctcgctttcgtgcgtctcaatctcttcatccatcagagcttcgatttcgaaggtgttcatgtgaccgctgataatcaggcgcagataatcgacgataaattcaagcatgacgctatccgcaaggatgcgtgggtagctggcgaagatctcgctctcacggggattttcaatatcgcgttccagcgaaaacatccccatctgccgcgatttcgccatcaaccgataaagcagagccagcagatccatatacattgctttggtgtatttggagcgacgaaacagcaacggcagcgccttcagcgtgcctttaatcgctttgccattattgccgacgataaacgacccaatccctgcaccggcaataatcaccagttcagcgggttgatagagtgctccaaggcttccaccggtcatcaaataaccgccgaaaactgtaccgagaacaaccaggtaacctaataagataagcacgacatcatccttccactgttgaccatgacaggatgttcagtcgtcaggcgttaacacgcgataggggcaaaaaaaagcagcggtacatcgttaccgctgctggaatgtttcgccacaccgtatcagttaaacagcctgtactctctgttcatccagcagttgtgggataatatcggcaggattctgggaaagtttacgtctttttactgcccgggatggcggctgacataagctgcaggcaaagctgccaacaggctggtgagcatgggtaataaaattgccgccgcagcagttgcagctggaaagttgcagtaatccactttcaacaaaccgcaccaatgtccaggcacgggttaatgccagcagcggtccttcttctgcttgcgggcactgttcaaggtataaacggtaggctttgatcaccgcatcgacgccattacacaagccagttttcagtaaaaactgccatgaattacagaacatcgaagcatgaacgttttgttcccaggtcataaaccagtcggttgagaatggcagcatgcctttcggcggtgggcttccgcgcagttctttatagagttttatcagacgtccgcgacttaactgtgtttcgctttccagcatctgcaaacgagcgcccagggtgatcaattccattgccagctgaatatcccgcgcttcctgaacaatgcttttttcactcatgatcaggcccttttcttgcgcagcgcttcttcaggctgattaacatcattcagcaagcgtgttgagagcatgatgccggtatgaatttgctggagatcgtcaacgcgggaatcttgcgtcaactgagtaatcgtctggtggctgtcaaaacggaagtgacaaaccagttgattggtttctgccagcttaaccatttgcggaagagtcagtgccgctaacgttgtcgccatttcttcatttatgccgagacgaaacatagcggacgctttgtcctgaacaatcagacgctgtgcaagtagtaaatatgacaagttgatgtcataaatgtgtttcagcaactcggaggtatgcattattcccacccagaataaccaactttatttttatgcggtctcaccgcaccccgtgatgtcgccgggaagccccggtaaaaaataattagcattagaatagttgcgataagctgcaataagcagacccacctttttggtttaataagtccttacaaatagaagggggtctttacacttatctaagatttttcctaaatcgacgcaactgtactcgtcactacacgcacatacaacggaggggggctgcgattttcaataatgtgtgatgcagatcacacaaaacgctcaattacttaacataaatgtataagtcatacttttgttttgggtgtatttcaatctgttaaaaaatttttcgctacactggcaagcaaaaatgaaacaggaataatcgaaatgggatgttgcgcacagttaaaataactcaccgtaaataatcatctgctataaataatcgctttaatgcaataccagataagccatttttaaacaaacacttaccgcacaacaaactaattaactacaaagaaaggcaacaatcaacctaatgttaataaaatgttttacatatattaaccacttgttcaatatgggaaatcagtacattattttcttataaatacagttgaaatcatatgataaccaagagcaattgattaattgtatttactaatgaccagactaatatttacctgtttaactgagttgggattgcgtcgtttctccattaggagtaaagctttaatgtcacctgaagttcacagaataaggaacaggttatgagctatagcaatattcttgtcgccgttgcggttacaccggaaagtcagcaactgctggcaaaagcggtatctatcgccaggccagtaaagggacacatcagtttaattactctcgcttccgacccggaaatgtacaatcaattagctgcgccgatgcttgaagatttacgcaatgtgatgcaggaagaaacgcaaagctttcttgataagttaattcaggatgcggggtatcccgttgacaagacgtttattgcctacggtgagttaagcgaacatattctggaagtttgtcgcaaacatcatttcgatttggtgatttgcggtaatcacaatcacagtttcttttcgcgagcatcctgctcggcgaaaagagtgattacctcaagtgaggtcgatgtgctgttagttccacttacgggagattaaccgcacctacgcaagcttaggaaaggtagcaactttatcgcgctgctggctttctgcgcttcgcggaactatctgctttaggtcgctaatgaagcactcctgccagtggttaatatcgtttttcacgataacgtccagcatttctgcatgacgggaaatacgttccgccagcgacatagtcaatgcacgatccagcgcagctgcaacttcgtcacgatcgtagggattaacaattaacgccgacgttaactcgtttgccgctcccgcaaattgcgaaagaacaagaacgcccgggttggctgggtcctgagcggcaacatactcttttgccaccaggttcattccgtcacgcagtggcgtcactaagcccacgtcagagtagcggaatattttcatcagtaatttacggtcaaaatgctgattcaaataataaagcggcgtccagcctaattgcccatatttaccattaattcgtccggcttcattttcgagctgatgacgaatatcctgataggcttgcacatcaccacgcgacgttggcgcgatctgggtataacgaattttaccgtgatgttgcggatatttttccagtaacgcttcataggcgagaaaacgctccggcaaacctttggaataatccagtcgttcgacagaaaagatattttgtacgtttttcagttctgctttgagttgcgccagttttggcggcagtggaccggcagcctgtttcgctatttctttcggctcaatgccgatcgggtaaacttccgttcgaaacgctttgccgcaggctgtatggctttttgagttacgtgtcgtgacgcgggtcaggttagaaaggcaatccaggaacgccagacgatcgttctccgtctggaaacccagcaaatcataatcacaaagctgttcaagcaaggtgtcatatgtcggcagcgcgttgaagatttccggtgtcgggaaaggaatatgcagaaagaaaccaatgcgattattcacgccccgtttgcgtaattcatgcgcaaagggcaacaggtgataatcgtggatccagataatgtcatcgtcttgcaacagcggcagtaatttatctgccagcaacgcatttacgcgtagatagccatcccaggcaggacgctgaaattgcaccagatcgagccgataatgaaaagcgggccagagaacggcattggagaatttgttgtagtattcgtcaaggtcctgttcgctgaggttaaaagaggcccacgtaatgttaccctttttcaccttttttagcggctgatcctcattccctgtttcaccgctccagccaaaccacagtccacctgcggctttcagtgcccccagtatgccaacggcaaggccaccggcactggcggcgtgctcgtctggtggtgcaatccggttagatactacgactaaacgactcatagtcatcactcctgttattttctcttttttgttgtaatgcggtggttatcatttcaagccagctccagacatccggcacgcccgccagtcgccatgatgcctgagttgcacctgtgccaatttttactgacattccgcccagccggttaacgactgcgaagccagattcatcggttagatcatcgcccagaaatacgggcgttcgcccgataaagggagcttcctgcataaaggcagcaatcgcctcacctttactggtacctttcggtttgatctcgacaacacactttccctgctgtaacgccatttgtggccagatctgagtaatacgttgcgctaatgtcatcaatgcgtcttcatgctgcggagcctggcgataatgcagcgcaaaagccatccctttcgcctccagctccgcgccgggatactgggcgatgaccgtatgcagttgcacgctaatatcacgcgcaatcgcatccggcagatgaacgatatgcgttttaccattgatgtcacggcgctccgccccatgcacgcccgctaacgggaagcgataaggttttgccagtgcgtcaagctccaccattgagcgccctgaaatcaatgccaatgcaccatcacttgcggttgccagtagctgaagtccttgcagaatagtgtcaggcacgacgacctgatcgggatgcggtttgatttccgccagcgttccatcgagatcaaaaaaccaggcatatttcgcggatagttcaggggtttcggttaacggttctgtcacccggttctcctccttctcttttcttattgtgttgcgcagaacgcgctttacagacatgtaagtatagacagtgtgacgggggtcgccatttgcaacgaagaacagccaaccgttgtggcggctggctgtggtgggaaaaaacgctaaattgttgtggaaaaaagcatcagacagtgcgtttcgctttttgcttgtaacggtcgaaaatcaccgctgccagcaggattaagccgcgaactacgtactgtgcgaaaggagaaatattaagcaggttcatggcgttttccacggtgcctaaaattaagatacccgccaccacatatgagatttttccgatgccgcctttcagagaaacgccacctaaaacgcaggcggagatcacaatcagctcataaccaatcgacgtcattggctgcccactggtcatacgtgaagccagaataattccggctattgctgataccaggccagagagaacaaaaataataattttggtgcgaacaaccggtacacccgccagacgcgcagcctcttcgttcccgccaatcgccagggtattacgaccaaaggtggttttattcagcagcaagccaaagatgatcagacacgcgacggtgagccagattggcgcaggcagaccgaaccagttggcgtaaccaagggcaaagaagctttcatcttcgataccgaccgctttaccgtctgaaatgatgtacgccagacctcgaacaatctgcatcgttgccagtgtcgtgatcagggcatttattttgagtttggcgataacaaagccattgaccagaccacagagaatgcccagcagcaaccccgctgccacgccaatccacaggctttcagtcagattaataaccaccgccgtggtgacacccgcacaggcaattacggaggcgacagaaaggtcaaagtcaccggaagcaaggcagaacaacatgccacacgccaccatccccgacatggaaattgccaggcccaaccctttcatattaatgaaggtggcaaaatttgggacaaaaatggcacaggcgataaaaagcaccgcaaacaccaccagcatgccgtactgatcccagatacgcccgaagctgaatgacgacttaggtgcgccagaacccgatgtagaaacagaagacatcatactctccttactcaggcaactgcctggctgactttaggcatcgcaaggctcagtgcctgacgctcatctgcctgctcgtgtaacaattcaccggcgatttcaccttcgcgcatcaccacaatccggtcggcaacgctgaggacttcaggtaagtcgctggaggcaaacagcaccgccacaccctgcgccgccagcgcataaatcacgttatatatttcgtgcttagcaccaacatcaatgccgcgcgtaggttcatccagcaaaatgaccttcatctcttccgataaccagcggcccagaatggctttttgctgatttccacctgagagattcataatcagttgctcagcgcccggcgttttgatgttgagcgaacgaatgtggtgatcggcattgttttcttcccaaccgttgttgattacacaaccgccgagcacatgtttgcgtctggcactgatgttgatattgtcgcgaacggagtgcacaggaataatgccttccgctttgcgatcttccgggcagagcatcatgcctgcggtaatagcgtggctcggtttacgaatatcgatcggctgttggtcgatataaacctgaccggcggtaatttgcgtaccgccaaacatgcctttcattaattcgctacgccctgccccgaccagaccaaacagaccgacaatttctccactgcgaaccgccagacttattggcgtacgcacgcctggtgctttcacagcatcaagacgcagccgctcctcgccataactacgcggttgccagccgtagatatcgccaatgtctcgcccgaccatcgcctgcaccagtgcgtcgtggtcaacctgctgcatatcggtaaaggttttgacataacgcccatctttaaagacggtgatggcatcgctgagggcaaatatttcttccatacggtgagaaacgtataagatcacccgcccctcttttcgcagttcacgaataacgcggaaaagattgtcgatttcgcgggcagagagggagctggttggctcatcaaaggcgataattttggcgttacgcgccagcgctttggcgatttcaaccatctgccactgaccaatggagagatatttcagcggcgtgtccgggtcaatatccataccaagatgtttaatttgtaaacctgcctcataattcagcaatgaacgattcacaatgccgcctttatgcggcagctggccgagatagatgttttccgcgacggtcatttccggcacgagatgcagttcctgataaataatcgccacacccgcgttaagtgctgcggtcgtgtcggaaaaggacatttcctgcccattaatcactacagaacccgtggttggcgcatagtttccgctgaggatttttaagagagttgattttcctgcgccattttcacccatcaacgcatgaacctgaccggcatagcagtcaaaactaatatccgtcagcgccttaacgccgggaaacgttttaccgatgccgcgaaatgagagatacggggtagactgttgcataacgtctccgtgaatcactggtcgttcacaccccctctgcatcatgcagaggggaatttttccggcaaattacttaccgcctaaaccttttttctccagttcttctttaaagttgtcacgcgtgatcagcaccacgtcggtaacttcggtgaatttggtcggttcaacaccttttgcaacccagttgtaaagcatttcgctggacttataaccatgtacatccgggcttggcagcagggaaccgtagaagccggttgcctgtgccttagacagttcactcaccgcatccacaccgttaataccgatgatatcgctcgctttaaagccctgaccttccgtcgcgcgtacgccgcccagcacggtgctgtcgttcataccgacaatcagccaatgtttaacttccggatgttgaaccagcattgagttggcagcgtcaaatgcccccgggatgtcgttagatttggtaggtacctgataaatttgtttttccgggaatcctgcagctttcagcgcatccatagaccccgtagtacggcgacgagccgtatccagttcgttggaggtaatcgccatcaccgcgctttctttgacatcccagccacgtttctgcatctctttatacagttcctggccctgacgttcgccaattttagtcgccgccatcatcaccagcggaacggtatccattggcttacctttggcgttaacaaactggtcatccacggcaatgactttcatatcgtagccacgcgctttcgcgacgatggcagagccgagtttggggtccggagtacaaataacgaaaccttttgcgccactggcagccaggctgtcgatcgcgttcaatgttttttcgccatccggcacggcaatcttaataacctcaaaccctaaatccttcccggctttatcggcaaacttccattcggtctggaaccacggctcttccggttgcttcaccagaaaaccgagcttcaggttctccgccatagcggattgtgacataacggctgccagaccaatggctgccagggctttagtaaatttgtgcatggttctctccagctttagtgtcgttttgtgtagggcaaaaacgaatgacattcgttaaattaatcggaaaacaaagcattaccttttaactaaaagataagtgactgtgttgacatagttttagcgagaaattaattctccataggagagcaatatcacatcgcagaattacagtgagaacgtgcataaatttagcgggaaaagacataagggaaagccaatttgtcagacaaattgtcgaatgcacagcagattaatccataagattagcctggaaatccttgttgtctttggtacccatgcgggatgtcttctttttaaccagtcaataggccgcattacctggcgttgagtttttgaaatggtgtaataaccgcaactcaaagatgtggaaaatgcacgtcattcatttcgtcattaattatcactgtgctcattaattaacagaacacgtataatgagagccatctcgcaaaaatgaaaaaacgttttataaaatcatcacttcatcatgaattcaaattcattgattaatatcaacaagatacaaaaagcactatcattaaaattcattgcagttacattgatttcatcaatgaaatgtaaaaatatataaacttgatgatttaagcattttcttatacccgttcaggtaatgactccaacttactgatagtgttttatgttcagataatgcccgatgaccttgtcatgcagctccaccgattttgagaacgacagtgacttccgtcccagccttgccagatgttgtctcagattcagattatgtcgctcaatgcgctgagtgtaacgcttgctgataacgtgcaactttcccttcaggcgtgattcatacagcggccagccatccgtcatccataccacgacctcaaaggccgacagcaggctcagaagacgctccagtgtggccagagtgcgttcaccgaagacgtgcgccacaacagtcctccgtatcctgtcatacgcgtaaaacagccagcgctgacgtgatttagcaccgacgtagccccactgttcgtccatttcagcgcagacaatcacatcactgcccggttgtatgcgcgaggttaccgactgcggcctgagttttttaagtgacgtaaaaccgtgttgaggccaacgcccataatgcgtgcactggcgcgacatccgacgccattcatggccatatcaatgattttctggtgcgtaccgggctgagaggcggtgtaagtgaactgtagttgccatgttttacggcaatgagagcagagatagcgctgatgtccggcagtgcttttgccgttacgcaccacgccttcagtagcggagcaggaaggacatctgatggaaatggaagccacgcaagcaccttaaaatcaccatcatacactaaatcagtaagttggcagcattaccacccgttcagacgttattcttatttcagatcatcgtcagaattgactccacgatcacatttcggaccggcagaaaggaattattctgcaaacagtaattatggtgttttgatttatcttgcacctctccacttctggatataaggatattaggtatggcaaccgctggaatgcttctcaaactcaactctcaaatgaaccgcgagttttacgcatccaatctctaccttcacctgagtaactggtgttctgaacagagtctgaacggcaccgccactttccttcgcgcccaggcacagagtaatgtgacccaaatgatgcgcatgtttaactttatgaagagtgtcggcgctacccccatcgttaaagccattgatgttcccggtgaaaaactgaactctctggaagaactgttccaaaaaacgatggaagaatacgagcaacgttctagtacgttggcacagttagccgatgaagcgaaagaactgaatgatgattcaaccgtcaatttcctgcgcgatctggaaaaagaacagcagcatgatggtctgttgctgcaaaccattcttgatgaagtgcgcagtgcgaaacttgcgggtatgtgccctgtgcagaccgaccaacatgttctgaatgtcgtgtcacaccagctgcattgatcatcatcggcgctaatgcattgcgccgatgaaggttttgagaaaccgctgcctcatctgtttgaagcagcggtttttttaatgggattcaccctgtggggtaaacttgagttcaataagcgcgatggctttttggattgcccgcatggtgaccgggtctgcggcggcgggatggttagtaaagtcgatattcttcagctgactggacattttttcacgaacttcaacgggcgcgattacatcgagaacatccagaatttgtttgataaccaactggcaagcaaccacatcagaaaccaattcctgatcggcattcagcggctgggacatcgtaaactcctgatagcattttgaaagccgttatagtagcgacttcacatcttcagcgatagtcacatccaccgtcatcaggacacaaaaaaacctgccggagcaggttttttgttatcggaacatattgcctggcggtacgtctttgaacgtcttgcaatagttattgaacatacttttcaggattttgcgcagtttcatcgcggcactccgaccatttgttatacaggtgttattgtctttgcgcttataatatgacaaccatcacaaaaatcaatctttatgtgatacaaatcacataaatacccctttaatgttataaaaatgataatcaaaaaacagcccccctatttctgacacctacagatggcaagaaatagcgcctgccaggcgtcttttccggccattgtcgcagcactgtaacgcgtaaaatagtgctttctcttactcttctggctggaccatgagacttctgattctgactctttcattaataacgctggcggggtgtacggttactcgccaagcccatgtgagcgaagttgacgcggcaacaggtattgtacggttagtttatgaccaggcttttttgcagcatgcccataccgatcgttatgtcagtcgcgggatcgccgatcgcgcatgccagcaggaaggctatacccacgcggtcccctttggtcagccagtaggcaactgtagcctttttgcgggttccttatgtttgaatacggaattcactttgtcatatcagtgccatcattccgccttccctgtctttctctaaatattttaatcagcgaggggatcttcgctgattaaagaaatagcggtaatgcgttttattcccattcgtatttttaataattgaagtttatattttaccttttgcaaataataaaataacaaattatagtgacgccacagcaacaaatataacctttgtggagcactatcatgctgaaaccagaaatgattgaaaaacttaatgagcagatgaacctggaactgtactcttcactgctttatcagcaaatgagcgcctggtgcagctatcataccttcgaaggtgctgccgcgttcctgcgccgtcacgcccaggaagagatgacgcatatgcagcgtctgtttgattacctgactgataccggcaatttaccgcgtattaataccgttgaatctccgtttgctgaatattcctcacttgatgaattattccaggaaacctataaacacgaacaattaatcacgcagaaaattaacgaactggctcatgctgcaatgaccaatcaggactacccaacatttaatttcctgcaatggtatgtttctgagcagcatgaagaagagaaactgttcaaatcgattattgataaattaagcctggcaggcaaaagtggcgaaggtctgtattttatcgacaaagaactctctaccctcgacacacaaaactaatgctctccggcggcaggttttctgccgccgtttcaaatcagtgacggcaaatcttactctgatcggttgaaaaaccttcttctgaaggtataaatttgccttttgctgccagaaacgccaccaactctcccgcagtcatcccttctgccgagcaggtgtgaaaacgtgcctgttcaccaaaacgcgctttaattgctgcttccagactggcatgcgtatattgctcgcctgattcaatcatcatatttaacacttcgtgaccgtgaatagagtccatcgttcctcctcaaaaaaagcctagcgtagcgattgccgcttatgaagactttgcgccagcgcaggactgaatgctttttattgtacatttatatttacaacatatgtaacgtcggtttgacgaatcagccgttatgccttaacctgcgccgcagatatcactcataaagatcgtcaggacagaagaaagcgtgaaaaacagaactctgggaagtgtttttatcgtggcgggaaccacaattggcgctggtatgctggcaatgccgctggctgcggcaggtgttggttttagcgtcacgttaatcttgttaattgggctttgggcattgatgtgctacacggcgctattactgctggaggtgtaccagcatgttccggcagataccggtctgggcacgctggcaaaacgctatctgggacgctacggtcaatggctgacgggcttcagtatgatgttcttaatgtatgctctgactgcggcatacatcagcggtgccggtgaattgttggcctccagcatcagcgactggacaggtatttctatgtcggcaaccgctggcgtgctgttgttcacttttgttgccggtggcgtggtttgtgtcggaacttcactggtcgatttatttaaccgttttctgttcagcgccaagattatttttctggtggtaatgctggtactactgctgccgcatattcacaaagtgaatcttttaaccctgccgttgcaacaggggctggctctgtctgcaatcccggtgatttttacgtcgtttggttttcacggtagcgtgccgagtattgtcagctatatggatggcaacattcgtaagctacgctgggtgtttataatcggtagtgcgatccccctggtggcatatattttctggcaggtggcgacgcttggcagcattgattcaacaacctttatgggattgctggctaatcatgctggattaaacgggctgttacaggcgttacgcgaaatggtggcctctccgcatgttgagctggcagtgcatttatttgctgatttagccctcgccacgtcatttctcggcgttgcgttaggcttatttgattatctggctgatttatttcagcgttcaaataccgttggtggacggttgcaaactggtgcaattacgtttctgccgccgttggcgtttgcactgttttatccacgaggatttgtgatggcgctgggttacgccggtgtggcgctggcggtactggcattgattatcccttcgctgttgacctggcaaagcagaaagcacaatcctcaggcgggttaccgggtcaaaggtggtcgtccggcgctggtggtggtgtttctctgtggtattgctgtgattggcgtgcaatttttgattgcggcagggttgttaccagaagtggggtgatcagatagcctcaaattccttattgggtgccagaattaacgctgacacccaatttggcctcttaatgcaggcagcactgcttaaatttcttaccactaccgcacgggcaaggatcgttacgccccggtttctcttctgctttgatcggttgctgaacagctttttcctgcggatgcgccatccagtacgcatgtagatcaagcgccgccagtcgaatggcatctacgctctcttcaaacgcttctggcgacatcttttctacccgctcgaagttttcctcagtaccgtgcagcgcaatcgcctccagcgctggttttaacgaatcgggcaacgttgaccagtcagaaagtgccacgccccgcatatagccaaagcaccactcctcaacaatcgtcagctcgctgccatcaacttctcgcaagccgaataacggctcaaactgctccgggaattcgttcagacgctctgcggtatcggccatatgttgaaaagccagattcataaagcgcgtcatctctttctctgacgcccagcgcggcacatagtcagccccaccccacacggcaaccagccactgttccggttcaatctcttgcggagaactcaacaccgccgtcaataaaccgtccagctccgccacatcaaggatggcgtggtcagtgttgtatttggtcagaatatcgtccagccattccaactcactttcgtttaacggtcccgttttcatacgcttttccttgtggatctcaactcgccagcacctatcttacatgccggtccgtatcagagatactttttgagtggctttgctggtgattaaaaattaaggagggtgtaacgacaagttgcaggcacaaaaaaaccacccgaaggtggtttcacgacactgcttattgctttgattttattcttatctttcccatggtacccggagcgggacttgaacccgcacagcgcgaacgccgagggattttaaatcccttgtgtctaccgattccaccatccgggctcgggaagaaagtggaggcgcgttccggagtcgaaccggactagacggatttgcaatccgctacataaccgctttgttaacgcgccaaattcttcaggcctttcagccagacatccgcttgacgccgatgtcttttaaactggagcgggaaacgagactcgaactcgcgaccccgaccttggcaaggtcgtgctctaccaactgagctattcccgcattcatcaagcaatcagttaatcacttgattttattatcgtctggcaatcagtgccgccgttcgatgcgttgcattctacttacctggcgcgatgagtcaacgatatttttcaccacttttgatcgtttgctgaaaattacgccgaaacgatcactgatcaagcaaatctgcacgcgcagcgctcaaatattgcaacattgaccacagagtcagtaccgcagccacaaagaaaagtgcaataccggcgtactcaacccaaatgttcggacgccacagcagccatgccaacgccaccatctgggcagtggttttcactttcccaatccaggagacggccacgctactgcgtttacccaactccgccatccattcgcgtagcgcagaaataataatttcacgggcgatcatcgttgccgccggtaatgtcacccaccagctgtgataatgctcggttaccagcaccatggcgatagccacgagaactttatctgccacagggtcaaggaaagcaccaaaccgggtactctggttccagcggcgtgccagaaaaccatcgaaccagtcagtcaccgccgcgacgcagaaaatgagcgcggcggcaaacggcgaccaggtgacaggcagataaaagaccaatacaaagaatgggataaggatgacacggaacagtgtaagcaacgtagggatattaaattgcataatgacgggtaactatctgttgtcagtaagattacccctatgttgctacagagacatcaatgtttcaacgaccagaagatcttttctgccagaccttgcgaaatacccggcacttttgcaatttcctcgacgctggcgttacgtaaaccttgcaaaccgcccatatatttcaacaacatttgccgacgttttggcccgacgccttcaatggtttccagggaactggtatttttgaccttcgcccgttttttacggtgcccgccaatcgcgtgatcatgtgattcatcgcgaatatgctggataacatgcagcgcgggtgaatctggcggcaaactaaatccctcaccttccggctcaaagaacagcgtttccagtccagccttacgatctgctcctttggcaacgccaagtagcagcggatgatttttatcccatgagacatccagttcggcgaagacatttttcgcctgcgcaagctggcctttgccgccgtcgataaggatcacatccgggatcttactgtcgtcaatggctttaccataacgccgacgcagcacctgattcatcgccgcataatcatcgcccggcgtgatgcctgtaatgttatagcgccgatactccgcacgcagcgggccgttagcatcaaacaccacacaggaagcgacggtttgttcgcccatggtatggctgatgtcaaagcactccatccgcttcacttccggcaatttcaacacgctggcaagcgcggtcagtcgctggtgaacggtagattgctgcgaaagtttgctggttaaggccgtcgccgcattggtgcgcgcgagtttcagataacgcgccctatcgccgcgaggtttggtttgaacattaatcttgcgtcccgccagttctgaaagggaatcggcgagcagcgttttatcgctaagattaaaatcgagcaggatctcacccggtaaggtgcgcatctggctgccttgtaaatagaactgacctacgaaggtttctaccacctcgctcagttccgtaccgccaggcactttcgggaaatagctgcggctgccgagcactttgccctgacgaatgaacaatacgtggacacaagccatgcccgcatcgaacgccacaccaataacgtcaaggtcgtcgccggtattggaaacaaactgtttttcggtgacgcgtcgcaccgcctgaatttggtcgcgaatacgtgccgcttcttcaaactccagattctggctggcagtttccatacggctaatgagttgcgtaagcacctgatcatctttgccagacaaaaacaggcgcacatactcgacctgctgagcgtattcttcttcactcaccagtccttcaacgcacggtcccagacagcgccctatctgatattgcagacacggacgcgagcgattgcgataaacactattttcgcactggcgaatggggaatatcttttgcagtagcgccagtgtttcacgtacggcatagccattcgggaacgggccgaaatattcacctttagcatgcttcgcaccacgatgcatcgccagacgcggatgggtatcgccactcaggaagataaagggataagatttatcatcgcgtagcaaaacgttgtaacgcggctgatagagtttgatgtagttgtgttccagcaacagcgcttcggtttctgtatgagtaaccgttacatcaatttgctggatctgggcgaccagcgcttcggttttgcgcgaagcgaggttgctacggaaatagctggaaagccgttttttcaggtctttcgctttgccgacatagataaccgtaccaccagcatcgtacatgcgataaacgcctggctggctggttacggtttttaaaaacgcttttgcgtcaaactgatcactcactgacttgataatgtctccgcattacacagaccatggcgaattgccaggtgagtcagctcaacatcgccatgaatgtttagtttactgaacatacgatagcggtagctgttcaccgttttcggactgagattgagctgttctgagatctcattgaccttctggcccttggtgatcatcagcataatctgcaattcacgttcagacaaactggcaaatgggctttctgttttttctggttcgatctggcttaacgccatttgttgagcgatgtcagaagcaatgtaacgctgccctgaatagacagaacgaatcgcactcacgacttcctgcggagccgcgcctttgctgaggtagcccgcagcaccggcctgcatgactttcgctggtaaagggttttctgtatggacggtaagcatgatgattttgacatcagctgtggaacgcgcgattttacgcgtcgcctcaagaccgccaatgcccggcatactcatgtccattagcaccacgtcaacggcatttgcccgacaccacttaacggcgtcttcaccgcacgatgcctcaccgacgacttttataccctttatatcttccagaatgcgtcgtatccctgcgcgcaccagttcgtggtcatcaacaagtagaacgttgatcaaaggaatatctccagaaatagggataacgctactgatagttagtcattcgtatattagcggtttttattgcaactttgaaacgttaaaaatggtgggtattcgatttttctctcgtttttgtcaattcgattgtccacagttatggtcacgcccgtcaccaacggcttaccggatcgtttcacagtaagccctgcgacgaaatgtgacaaaaattacctttattcagcaaaaatgaaaatcagcccgctgaatatgtaacattaattaacccgaacaatacgggcaaaaaacattcatgataaaaatatttattggtcattatattaacgcatttaatagcaccgttgacgatacgctcaaaaaacaaccactgctatttttagcaaagcttatggtatactccgccgccttaacatttttcaccgcaaattttcattgcaacatgacgaggaaaataaatgagtacgcctgatttttctactgccgagaataatcaagaactggcaaatgaagtctcctgcctgaaagcgatgctgacgctgatgctgcaggcgatgggacaagctgacgcgggccgcgtgatgttaaagatggaaaaacagcttgcgctgatcgaagacgaaacccaggctgcagtattttccaaaacggttaagcaaattaaacaagcctaccgtcagtaatataaaaccggctgatagcgtgcctttcagccggtttttgcatctggcacgcaggacagaaaagagatcaaattaagccagtagcggccgcgtaacaggcaacctgggtcttattcggtgcattgatttttttctgcatgtttttctgatggaaattgaccgtattctcagagattgacaaaatcatcgctatctctgctgatgtcttcccttccgccgtccatttcaaaatttctttttcgcgcttgctgaaattcatctctggcgtcatcactatttcatcatttaaacgcatcagagccatcagactttcgcgcaccagtaactgcatttttaattgcagttcatcactaagaatgggtatttcgcgcgcgctgctacgggaaaaggacaaaaagcccagcgcccggtttggcagcattaaatactgagtgacaccgcggcgtaaaccatgtgcgcgcgcggcttcccataacggctgtgcttcgctgaataagtcatcattccacattaaatggccctgactaaagttttcagggttcagcaccggatcaattgcgagaaagttttttgcctgataataactaacccacgcctcagggtaattggtgtagaaagccactttaggtcgcgtgaatggtaccgggtggcgaacacataacgaatagtaatcgtactctagctgctgagcctgaagctctatttcatggtagacctcttctgcggcctccatcctctgaaaacgcaacagcatcgtgcgacgccagctgaaaaaatccgtatcctgcatagtaaaccgcaacgcccctgagagtgagtatcatttataatgataattcaaactatcacataaataagatttatatataatttatattattcaggcaatgaattacttttgcaagccatcgcattctcttatgttattaatgagttatgctgatttgttaagctgttttatcacgcttgaaatggcgtcccgccccgacaggtgaatcgtcggggctgattttttcttattattgcagcagaaacttctcgaggaactggcgggtgcgaggctgctggggatcggcaaataacgcttttgctgccccctgctcgactatccgcccctggtccataaaaatcgcccggtccgcaacatcccgggcaaagctcatttcgtgcgtcacaatcaccatcgtgcgcttttcctgcgccagctgacggatggtgttcaggacttcgcccaccagctctggatccagcgccgacgttggctcgtcaaacaaaatcacctcaggacgcattgccagcgcacgtgcaatcgcaacacgttgctgttgaccgccagacaaacgacgtggatagctggtttctttaccggccagcccaactttcgccaacagctcgcgagcgcgcgccgtggcctcttctttcggttcgcctttgacgatcaccggcccttcaataatgttttccagcaccgtacgatgcggaaacaaattaaagttctggaagacaaacccgacgtgctgacgcaactggcgaatcagcgatttttgctgacttaatgaacgtgcagtatcaatagtgatatcgccaacggtgatcgttcccgcttcgggttgttccagcagatttatgctgcgtagcaacgtggttttgccggaaccactcggaccgataattaccaccacttcgccaggctttacctcaaggtcgataccgtgcagcaccgtctgaccgtgaaattttttcaccaggttcttaacttcaatggcactcattttggttctctctcctggcgattaagttgattctcaaaatggttctgcaacgtcgataacacagtcgccatgatccagtagatgagcgaagccgccaggtacatggtgaacacctccagcgtgcgcgaggtaatcaactgcgcttgacggaacagctccggcacctggattgtcgcggccagcgacgtatcttttaccaggctgataaagctgttcgacagcggcggcaacgccacccgcgccgcctgtggcaaaatcgcgcgacgcatggtctgccacggcgtcataccaatactggcagctgcttcccactgacctttatcaatagaagaaatggcggcgcgcagagtttcggcagcataggcggcagtgttgagcgacagaccaatcattgctgacggaatgggatctaattcgatgccaaactgcggcaggccgtaatagatcataaacagttgtgcgatgagcggtgtaccacgaaaaatagagatataaaaacgcgccagccagcgcacgggccagattggcgacaggcgcatcagcgcgagaataaaccctagcaataagccaaaaaacatgccgccgatactgagttgcagggtatacccagcccctttcaacaggaacggcaaggaatcaataaccagttgtatactttcttgcatgagcgttcccggagctaaacgtggggatgataggcgaacagcgcaggcgcaccgccggtatgaataaacagaatcggcccttcatctttgaaacgtttctgactgataccgtcaatcagacccgccatcgcttttccggtatacacaggatcaagcagaatgccttccagccgcgccagcaatttcactgcttccatgccttcgtcgttcggcacgccgtagccaggtgcaaaatagtcatcccagagtaaaatttccgctgatgcggtcagctccagttctttcgcaatcgcctgttgtaggttaaccactttcggcaattgatcggcaacggaacgcgacacggtcacgccaatcagttcgctttcaggcatcaggtgttccagcccaacagccagtccggcgtgagttccggcactgcccgatgcgaccaccaccgacgaaatattaaccgccccttcacactgttgcgcgatttccagcgcactctccacataacccagcgcgcccagagcattagaaccgccaaccggaatgacatacgggcgaaagccttgtgcttcgactcgcgtcgccagctcttccagttgggcattgggatcggtcagtgcgtcgcacatttcaatctgggtattgaacagatccagcaacaagcgattgccgttggttaaatagttttctgcggttgtgccaataggattttccagcagcgccacgcagtgcagaccgagtttggcagcgactgcggcagtctggcgcacatggttagactggatcgccccggcagtaatcagcgtatcggcaccttcgcgcagagcatctgccgcgagaaattctagcttacgtaatttattgccgcccattgccatgggggtgacgtcatcccgtttgatgaaaatttcccgtcctagataatcagaaaagcgcggcagatattcgagcggtgttggcgcgccgataaactccaaccgtggaaaacgggttaaattatgcagtggcataacagcctccgatgtgtgttgttgtgattttcttattatgcacgctgaaaacgcgtaaataaaaaaggcgctagtgaaagcgcccttttttgtcattatgctgattatttggtcacatcagcaccaaaccatttttcggaaagggcttgcagagtgccatctttttgcatttccgcaattgcatcgttcactgctttcagcaggtcttcatttcctttacgcagcgccacgccagactcctgacgggagaatgcttcaccggttactgccagcgtatcgttggttttcttcaccagatccagcgccgccagacggtcaacgaggatcgcatcgatacggcctacgcgcagatcctgatatttggtcgggtcatcatcataggtacgcacatcgacgccctgaacattctgccgcagccactcttcatagttggtgcccagaccgacacccacttttttgcctttcagatcagcagccgttttaatggtgccttcgttaccttttttcaccagcgcctgaataccagaaatggtgtacggggtagagaaatcgtattttttcttgcgctcatcagaaatggtgacctgattaatcaccacatcaatgcgtttagagtccagcgacgccagcataccgtcccatttggtcggttttagtgacgcctcaacgccaagatgttttgccagctgttgggcaaattccacttcaaaaccggttaatttgccgtcatccccctgaaaactgaacggcggataagtgccttccagccctaccagcagcgtgccgcgctctttaactttattaagcagaccttcatctgcaaaacttttaacgctcatgcccgcaaccagcgctacggccatcacactcatcaatgcctgacgtcccagatgtgctaatttcatatttaccccgaatgttgttatgtctgtttgcagtgtagagccattgtttgtaaacacaaaaacaactccgctacatcttattcttatttaatatatatcagaagcaggcaggctggaggatttctgcacaagtccggtacacgtttgacgctgatagtgttgatacttccgtaatgcgatgcggtaattgttggtgctggtggtgggcagccacggggcgaggatttcatcaaggaaaccgtcctgcagcggatcgagggaaatattttgctcgtgtagatgattccccaaacggcgcaaacgaacgacatattcacgcaccgtacctgggctcatttcagtttgctcaaaaagaaattgcttaaagccgataatatcgaaaaaatcactctgcgttttgcaatgtaaatcaccgcaaaatcggcacaatgccgcccatgatttttgttccgtttgccagccattttcatcaagcagcgcgtccaggcgggaaatctcgattttattcactattttgccgtcgcgaactaaggtaatgcgatcgagtaatttacggcaatgcgcgcaatgagtctggctgtgtttaaagtctttaagatagcggcttaatggccgtcttttcaggtgctgcaccatcattaagaactcctggtagtcaaaattaaagtgcggcatttactgacgttataacttacccagtttagtgcgtaaccgtttaatggcctggctgtgtaactgactgacccgcgattccccgacctccagcaccgcaccaatctctttgagattcagctcttcctgataatagagggttaataccagtttttcgcgctccggcaacgtttcgatggcttccatcacccgctggcgcagattactgtccagcagttgttgtagcgggttttctcgctgatgatcatcagtaaccagttcgatgctatcgccgtgctcttcgcgccactcatcgtaggagaagagctggctgttattggtgtcgagcaacatttggcgataatcggcaatatcgatccctaaacgttccgcaacctcagtttccgtggcgttgcggccaagttcctgctccagttgccctattgcctgtgccacttcacgcgcgttgcgtcgcacgctgcgcggcacccagtcacggctgcgaagttcatccagcatagcgccacgtatacgctgcactgcgtaagttgtaaatgccgttccttgtagggcgtcatagcgttcgacggcattaagtaacccaatgccgcccgcctgtagcagatcgtcaagttccacgctcgcgggcagtcgaacctgcaggcgcaatgcttcgtgacgcaccagcgggacataacgctgccacagcgagtgtttatccattacaccttcagcggtatagagtgaattcacgataaacagccctgcgttatatgagttatcggcatgattatccgtttctgcagggtttttaatcggacgattagtgggtgaaatgaggggttatttgggggttaccggtaaattgcggacagaaaaaaccccgccgttggcggggtttgagcgataagtgtaaattaacgcagcagagacagtacgttctgcgtggtctggttagcctgcgccagaacagaggtacccgcttgttgcaggatctgcgcacgagacatgttagacacttcggtcgcgtagtcagcatcttcgatacggctacgggcagaagacaggttgtttacggtgttgccaaggttggtgatagcagagtcgaaacggttttgtactgcaccgaggtcagaacgcagattgtcaactttagccaatgccttgtcgatggtttcgagcgggttggtagtagattgcaacgattttgctgcatcttcttttaccagaatcgggctaccaccttctgatttgctcagatacatagttttgccaagcccagttactgtcttaccatcagcgctaacttcataatcagcgccatttacaactaaagaactacccacttttttagcgttatttaagtccagatccgatgctgtagcggctttgttttcaaccttagttgtagtgaactgacctgcactatttttgtaaacaggatcagacgtttttaatgttgcgtccttccctgtcgcatcaatagtaaaggttacatctttgccatcaatattagcggttagagtgccgttaccactgccatcaaatgcatcagtgcctttgttggtgaaagtaataccttggtatttaattgaggcatctttagctaaagaaactgcggcttttgcaagcccagtcgcatcaatacctgtaccaccgacttttgtatcactcttagtagtcagagaaccatcggtagcgctaacaaaaattgcgtcaccatcctcattttgaactgctccactatctacattaacagtatagttatcagtaccgttaatttgataattatcagtacctgtcgctttaaatttagaaatcaggtcactgccagttgctttctgcgcgccatcgatattaaagccgtccaggccgagagttttcgcatcaatttttgccagattgatagtgatggtttccccatcattagcaccaacctgaattttcatttcattattttcggcaaggactttcacgccgttaaactgagtttgctcagatacacggtcaatttcttccagacgttgagtaatttctgcctgaatagaagaaagatcgctgtcagagttagtaccgttagttgcctgaacagtcagttcacgtacacgctgcaggttgttgttaatttcattcagcgcaccttcagtagtctgcgcaacagaaataccatcattcgcgttacgggaagcctgagtcagacctttaatatttgccgtaaaacggttagcaatcgcctgacctgctgcgtcatctttagcactgttaatacgcaggccagaagagagacgctcaatagcagagctaagagaagactgagatttgttcaggttattctgggtcaacagcgacaggctgtttgtattaatgacttgtgccatgatcttttccttatcaattacaacttgatgttattgggctgttgcccacggtttctcaccgtaccccttgtatcggcacctgaatttcgaactttagaaaattttagtttctctcctgttttttcttaacggctgaaatatccgtaatatacaactctactctgcgcatcatcttcgtgaatcaactattaaactttgcgcacaaattgccgataacccgcttatctactgtttgcaatcaaaaggaattaggtatggcttcatttacatctcttggcgttggttcgaatctgccgctggatacattgctaaacaacctgaccatcgctgaaaaaaaacgcttaaacccaattactcagcaacagagtgacaacaccgcacgtctgacagcctatggcacattaaaaagtgcattagaaaaattccagactgcaaatactgcgttaaataaagccgatctgttcaaaagcactaccgttaccagtagcaatgaagaccttaaagtttccaccgaagcaggtgctgcccccggtatctataccatcagcgtaacccaactggcgcaggcgcaatctttacgaactgattccccgacaatcattgcatcaacaaaagatgcactgggtgatgagtcatcagatacacgcacaataaaaattacccaagacggccgtaaagagccgctggaaatcaagctcaataaagatcagacgtcattggatgagatcagcaaaaccattaacgatgccgatagtggaatttccgctagtatcgttaaagtcaaagatggtgactatcaattggtattgaccgccagtgaaggtctggccaataaaatgaccatatctgttgagggtgacagtaaattaaatgatctgctggcttatgacagcaagaccaacaccgggaatatgaaggaactggttaacgcgcaaaatgcacagctaaacgttaacggtatcgatattgaacgttcaagtaacaaaattaccgatgctcctcagggagtgactctcgatttgaccaaaaaagtcactgacgtccgggtcacggtgacaaaaagcaacgataaagcaaccgaagcaattaaaggctgggtggattcatataactccctcattgacacctttaacaccctgacaaaatataaagaagtagacccaggtgctgaagcacaagataaaaataatggtgcacttctcggagacagcgttgtacgtacaattcaaagcggcatccgcgcacaatttgcaaacggagccagcgacggtgccttcaaaacattaaacgagatcgggattaagcaggacggcacgacgggtaagctgaaaattgatgatgataaactcaaaaaagtcctgaatgaaaatacagcatccgtacgtgaattgctggtaggcgatggtaaagaaacaggaattaccaccaaaattgccaccgaggtaaaaggttaccttgccgatgatggcattattgatagcgcacaggacagtattaacgccacactgaaaaaactaaccaaacagtatctatccgtcagtgccagcattgatgacaccgtggcgcgttacactgcacagtttacgcaattagataccatgatgagcaaactgaataacaccagtacctatctcagccaacaatttactgcaatgagtaattcctgatcacggaggtcagcatgtataccgcgagcggctcaaaagcctatgcacaaattggcgtcgaaagcgccgtaatgagcgccagccagcagcagctggtcaccatgctatttgatggagtgctgagcgcactggttagagcgcgcctgtttatgcaggacaacaatcagcaaggcaaaggcgtctctttgtcaaaagcgatcaacatcattgagaacggactgcgggtgagtcttgatgaagagagcaaagacgaattaacccaaaacttgattgctctttatagctatatggtcaggcgcttgctgcaagccaatttacgcaacgatgtctccgcagtcgaagaagtggaagcattaatgcgtaatattgccgatgcctggaaagagtcgttactctccccttctttgattcaggacccagtctgatgaaccatgcaccgcatttgtatttcgcctggcaacaactcgtcgaaaaaagccagctcatgttacgcctggcaacggaagaacaatgggaagaactcatcgccagcgaaatggcgtatgtgaatgcggtgcaggagattgcacatctgactgaagagattgacccgtccaccacgatgcaggagcagctccgcccgatgctgcgcctgattctcgacaacgaaagcaaggtaaagcagttattacagattcggatggatgaactggcgaaactggtcggtcagtcatcggtgcaaaaatcggtgttaagtgcctatggcgatcagggcggctttgtgctggctccgcaggataacctcttttgaatctgaacgagtcgatggctcgcgaataatccgattacggctacgcttctaatgttccccttgaatggagtcgaagaatgcgtaatcccacgctgttacaatgttttcactggtattacccggaaggcggtaagctctggcctgaactggccgagcgcgccgacggttttaatgatattggtatcaatatggtctggttgccgcccgcctataaaggcgcatcgggcgggtattcggtcggctacgactcctatgatttatttgatttaggcgagtttgatcagaaaggcagcatccctactaaatatggcgataaagcacaactgctggccgccattgacgctctgaaacgtaatgacattgcggtgctgttggacgtggtagtcaaccacaaaatgggcgcggatgaaaaagaagctattcgcgtgcagcgtgtaaatgctgatgaccgtacgcaaattgacgaagaaatcatagagtgcgaaggctggacgcgttacaccttccccgcccgtgccgggcaatactcgcagtttatctgggatttcaaatgttttagcggtatcgaccatatcgaaaaccctgatgaagatggcatttttaaaattgttaacgactacaccggtgaaggctggaacgatcaggttgatgatgaactcggtaatttcgattatctgatgggtgagaatatcgatttccgcaatcatgccgtgacggaagagattaaatactgggcgcgctgggtgatggaacaaacacaatgcgacggttttcgtcttgatgcggtcaaacatattccggcgtggttttataaagagtggatcgaacacgtacaggaagttgcgccaaagccgctgtttattgtggcggagtactggtcgcatgaagtcgataaactgcaaacgtatattgatcaggtggaaggcaaaaccatgctgttcgatgcgccgctgcagatgaaattccatgaagcatcgcgcatggggcgcgactacgacatgacgcagattttcacgggtacattagtggaagccgatcctttccacgccgtgacgctcgttgccaatcacgacacccaaccgttgcaagccctcgaagcgccggtcgaaccgtggtttaaaccgctggcgtatgccttaattttgttgcgggaaaatggcgttccttcggtattctatccggacctctacggtgcgcattacgaagatgtcggtggtgacgggcaaacctatccgatagatatgccaataatcgaacagcttgatgagttaattctcgcccgtcagcgtttcgcccacggtgtacagacgttatttttcgaccatccgaactgcattgcctttagtcgcagtggcactgacgaatatcccggctgcgtggtggtcatgtcgaacggggatgatggcgaaaaaaccattcatctgggagagaattacggcaataaaacctggcgtgattttctggggaatcggcaagagagcgtagtgaccgacgaaaacggcgaagcgaccttcttttgcaacggcggcagcgtcagcgtgtgggttatcgaagaggtgatttaaattcatccccggcggcaagccggggagatttcattacggcagtggcgtcggtaacggcgctttatccagcgcggcggcacactctgccgtcgggcgatccacacgctccatcgtcataccatcgtactcaatggtgttaccgtcacgctcaacctcgtacagctcacgttttacggtaacgttagtgagatcatcagacatcaatgtcaacttgcccggcacggcaatcacccgctgccactgacggcaatccagggtatcgccctctttagtgacaatcaggctgcctatcgcttccggactgaccagcgcacgttgcggccctttggtctgccagtagcccgccagccagtccggcgcgggggttttcacgacattgttatagttttcgacttcggcacagcccgccagcaacatgagcgcgcctgcaattgcgagttttttcatcattcgtcctgcatgagaagaaaagaggattgtggcattaaagccctgatgtcgccagcctttccaggttcagagagaaatttgatctaactattatttttgtgaattattaccccgaaaataaatttgcatgatgtatgattcgcgattcttgtttcaaaccttctgagttcagaggctacattcatgtcatggcagcaattcaaacacgcctggttgattaaattctgggcacccatccctgcggtcatcgcggcgggtattctctccacttactattttggcattactggcaccttttgggctgtcacgggtgaatttacccgttggggcggtcagctcctgcagctgtttggcgtccatgctgaagagtggggttattttaaaattatccatctggaaggatcgccattaacccgcatcgacgggatgatgatcctcggcatgtttggcggctgctttgccgcagcgctgtgggccaacaatgtcaaactgcgcatgccgcgcagccgtatccgcattatgcaggccattattggcggcattatcgccggttttggcgcgcgtctggcaatgggctgtaacctggcggcgttctttaccggcattcctcagttctcgctgcatgcctggttctttgccatcgccactgccattggttcatggtttggcgcgcgctttaccctgctgcccatcttccgtattcccgtgaaaatgcagaaagtttctgccgcctcaccgctgacgcaaaaaccggatcaggcgcggcgtcgttttcgtctcgggatgctggtctttttcggcatgctgggctgggcgctgctcacggcgatgaaccaacccaaactggggctggcaatgctgtttggcgtcggctttggtttactgattgaacgtgcgcaaatctgctttacttcggcgttccgcgatatgtggatcaccggacgtacccatatggcgaaagcaatcattatcggtatggcggtgagtgccatcgggatcttcagttacgtacagttaggcgttgaacccaaaatcatgtgggcgggaccaaacgcggtaattggtggtttactgtttggttttggcatcgtgctggcaggcggctgcgaaaccggctggatgtaccgcgcggtagaaggccaggtgcactactggtgggtcggtctgggcaatgtgatcggctcgacgattctggcgtattactgggatgatttcgctccggcgctggccaccgactgggacaaaatcaacctgctgaaaacctttggcccgatgggtggcctgctggtgacatatttgctgttgtttactgcgctgatgttgattatcggctgggaaaaacgcttcttccgccgtgcggcaccgcagactgctaaggagatcgcatgaaaaatatcgttcctgattaccgccttgatatggtgggtgaaccctgcccttatccggcagtcgcaactcttgaggcgatgccgcagttaaaaaaaggggaaatcctggaagtggtgagcgactgtccacagtcgatcaataatattccactggatgcgcgtaatcacggctatacggtgctggatattcagcaagacgggccgaccattcgttatttaattcagaagtaatccctcattcccgctgtggcccacagcgggaacatcgttgcctctgacacatagattttacccgccccctctcctattcttttcagtatgatctcaggaggtttctatgtgtggacgctttgcccaatcccaaacgcgtgaagattaccttgcgcttctcgcggaagatattgaacgcgatattccctacgatcccgaacccattggcagatacaacgtcgcgccgggaaccaaagttcttctgctcagtgaacgtgatgaacaccttcatctggatccggttttctggggatatgctcccggatggtgggataaaccgccgctgattaacgcccgcgtagaaactgcggccaccagtcgtatgtttaaaccgctctggcaacatggtcgggcaatctgttttgccgatggctggtttgagtggaaaaaagaaggcgacaaaaaacagccttattttatctatcgcgctgatggacaacctgtttttatggccgcgataggtagcacaccgtttgagcgcggtgacgaagccgaaggatttttaattgtcactgcagcagcagaccagggtctggtagatattcatgaccgccgcccgctggttctgtcgccagaagctgcacaggaatggatgcggcaagagattggcggtaaagaagcatcagaaattgctaccaacggctgtgtgccagcaaaccagttcacctggcacccggtatcgcgcgcggtaggtaatgtcaaaaaccagggcgcggagttaattcaacctgtttgttgacatcctccacgccctgaaggacgaggatccctgctacgttcaggctgtcgcctgaatcatttcggtgggttcctgcttcaacgggcggcctgactgcaccatctctccacaggcaagaacggcgtgcccagccgctaaaatgttacgagcgccatttacatcggcgttcgctgtatatccacatacctggcatctgaatttactttgtgacaggcggttttctttcgctgtatgaccacagcacgcgcaacgctggcttgtatacgctggcggaacagcaagcacctgaccgccacgccagagctgcttgtactcaagctggcggcgcatttcataccagccctgatccagtatcgaacggtttaaacctgattttgcccggacattgcgccccggctggctgaccgtacccgctgctgactttgacatgttgctgaccttcaaatcctcaatgactatcattgcgtggtttttgctgacggtcgttgtgactttgtgaaggtagtccctgcggatatttgcgatacaggaatgcagtcgctgtattttgcgtttctgcttctgccagttgttgctgaatttgaccttgcggcttaactgtcgctgaagtctcgccagcttcttctggtttttctgaaaactgtttacaggctcaaagactgtgccatctgacagcgtggcgagtttagccacgccagcatccagcccgaccattgatgctgaagggtgaaccggagttgatacttcactttctgtctgaatactgatgtaccacttaccgcaggactggctgacagtgacatttttcacaacacccgtgacctgacggctgttccggtagcgcatccagcccagtttcggcagaaaaatacggctgttttcctgatcgagcttaacgccctgcgggtagcggaatacatcattctgtccccgctttttgaatcggggaaaagcagcccgattctggaagaagtttttgtaagcccgctcaaggtctttcagtgactgttgcaatggctgtgacggggcatctttaagccattgcgtttcagtggcatttttccactcaaccagccaggaagccattttcccgtaagggatgtatttattaccgacctcatgattctcattctgacgtgccagagcacgattgaaaacgaaacgacatgcgcctgcgaagcgcctcatttcacgctcctgttgaccaccgggtcttaactggaatttaaatgcttgtagtcgtttcacaggccaaatgatactttggtctgtgaaaaaagaaaccgatatccggcgtggaaggcattgtgttttcctgatgcatgttcacctggtctttgtcaccagataccgacgtcagatttttgaccatgacgcgacagaaaaactacgcacttacttttcaaatgtatgtgctgattttgaagctgaactggttgaaatggatggcgaaccagatcacgtccatttgttaattaactatcctcccaaactggcgatatccagtctggtaaacagcctcaaaggcgtatcgggtaggtgactgcgacgagatcgaccagatattgcagtcaggtattactacaaaggcgttttgtggagtcctggctattttgccagtagctgcggaggtgcgccaatatccgtcatccgccaatacattgaacaacagcaaacacctggttaggtggaaaaccacgccttatatccctgccctgaaggacggggttttacggcgcaccggataagcctggagattatctacaccagcatggacatcattgtactatgccccgtacatgccccatcacatcctcaacatcaaagtattagagccttgcaaaccattatgcgtctcagtttgtctcatctatcttacgcaaaaaaaatagaactaatatcaagcggcgctatattgcgtattaaataaaaccacctcaattacattaataaatctaaacaaacatcatgcaaataatttccatggttatttctaggctatttaaattaaataaattatgagtcaatcataaataacaacctttaatataatttaactaccaaatttatattcgttcacaaaatagtcatgcattgtgtgcaatagaaacagttcagataaagatagggatctacttcacaatttaaatgagaaactaaaacttacatcttgaaataatctcattgattggatgaatatttgtagtgcagtgacatcatttttaaataatagttcaaataaaaggctcacgatgaaaaaattaacagtggcaatttctgctgtagctgcatcttaacgtataaactagatttaataacaacgaactagatttaataacaacgatatccgtacctatccggatatctaatgtcataagcatccctttaattatcccctcaacctcttgtaactttcccactcttgaactccacatagtccaaacgccggatgcaaaaaaatcacacgtgcatttctgaaattgtgatggaggaagatagtatcaattatatgtgcttataaacgtccccgattagcgcagaagtcaccggattgttcaggctccaataggttgagtatgccgtatttattttccaaaataaaaatctatgctgttgctccttcataaaatacttttactctctggacgcttttcttagctctcttggtgttatcttaaaacgattatggaacctttcagtaaaacgagaaggacacttgtaaccattttccctggcaatctcgctgatgggttttactgtcgtttgtatagcagacaacgcattatttaacctcacgtcgtccaatatactttgaaaacttactccctcgcttgccagacggcgatgcaatgtggaaacagaaatgtagagatatctcgctaccttgtttgctgtccattttgttccaggttcggatagcattaggttataacaacgacttattaatgattgtttactatctgataaaagtaaacaattaacatgatgtgctcctaatgaaagtagaacgcccattgctaagtgttcctgaatttgcgttgagaagcctcgggaaatagatgtttttagttgctcccaacaatatattaactcgggattctgaggtaagcagaaacctgtcgtgttacgaatttgatcggttatcgcataaagattttggaacttttcaattagatcaatgggataataaagcatttctgcaagataaagacctgcttctgggtaattcgcaatataaaattcatatccacagggaaataatattatctgattattatcaacagttagactatgcgtctcccaattgataatttttttccctgacggatacgacataaagctggcataagaggcttaaccctgtgaatctcatgatgtttatgcatccgtatttcttcaatctttaggttagtcctatcttttgccagcatactcttatcctactttacctcataaacgggtattatctcagcggttgcaattttattggcattaagcatataaccaactaacgctccgctggaattagaatccacaggaatcttatcagtttttagagcccatattttaaactggtaatgatggggtttatctcctttgggaggacatgctccaccaaatcccgcatagccaaaatcatttcggccttggacagcaccagtcggaagttttgtaccatcacgtcttcctgcatcagcgggcaaatatgttaccgttgctggaatattagcaacagtccagtgccaccatccgctgcctgtaggcgcatctggatcatacacagttacggcaaagcttttggtgccttctggagcaccagaccaggttaatgagggcgatgtattacccccctcacacccaaatccagaaaatacatgagacgttgtaagttgctctcctgtttttatttcattactagtgacctgaaatgctgcggcctgcgcagaaaatgttatgaatgccaatacacttgaaacgataagttttttcataaaaacctctttgttgtgacctatcgttattttatttgatgtgcattgatctcattatgcaaaaaggcgcaatgatcgcgcaaatgcaatcataattataaagttgccccgaacattagccataatatgcacaaatcagattcctgttatctcaaggatgattattttttaatgcggtgcgcttcgtgacaacaagttaatgactaacacaccagcacaaatcaacatcatgcctatgatggctggcaagtccagtcgttggccaaaaaatccccaggaaagcaaactaatcagaacgataccgactcctgaccagatagcataagcaatccctgtaggtatataagccagtgtctgagctaataaccaaaatgatgcacaatagcaaataattgtgccaacagagggccataaccgtgtaaacccctctgaaaacttcattaaggttgtaccaatgacctctgcaagtattgcgccaccaagataaatataagggttcatagcatattctttcctgttcatactggagagaattgtactacagtttgaacacaactcaccgttttcatcctggtgtatgtgtatccagggggctctggcgtggcaagagataaaggcaggaacaataatgatcagaaggaaccccaggctaacaaaagagttcactcttcctatgagcaaagcgaagacaaaacatgttatcgcgtttacggatcgtggatggcagaaaactttcaggatcaggtatccattttaaaccagaaattgagtgagtttgccccatccatgccccaagcggtgagattggaagtaattaacaacaggttacaaaacctacacctgcatggacatcacttcctgatacgccgccaccagcttattacgcacctgaatccccatttgcatagaaactgaggctttttgcatatcggtcatcacatcgtttaacgccacgccgggttcaccgagggtgaatttttctgcctgcgtgcgggcagctgtttgtgtatcgctaatgcgatcgagcgcggcgtgcagctgcccggcaaaactaatggtcggttgcggcagtgaatcctgtgcacgcgcactcatcgccgtagcctgtaactggctgataaccccttcaatcccctgtatcgctgacattttcgtctcctggataatttctggtagcaaagcctaccagtaagtcaataagacaaaggcgctaaatagcaacaaaaaaacgggtttattggcggatagaaaaaaacgaaagcacaaataatggcagcgtcaatttttcgagtttgctgacccgggagtgagtcttgttccactttgccaataacgccgtccataatcagccacgaggtgcgcgatgaatgcgactgcagcccagacaaaatctcttgagtggcttaatcgcctgcgtgcgaatccgaaaattccattgattgttgccggttccgcggcagtggcggtcatggtcgcactgatcctgtgggcgaaagcccccgactaccgcacattattcagcaatctttccgatcaggatggtggcgcaattgtcagccaactgacgcaaatgaatattccttaccgcttcagcgaagccagcggcgctattgaagttccggcagataaagttcacgaactgcgtctgcgcctggcacaacaaggtttgcccaaaggcggcgcggtcggtttcgaactactcgatcaggaaaagtttggtatcagccagttcagcgaacaggtgaattatcagcgggcgctggaaggcgagctttctcgtaccatcgaaactatcggcccggtaaaaggggcgcgcgtacatctggcaatgccgaaaccgtctttattcgtccgtgaacaaaaatccccttctgcatcggtgacggtaaatctgttacccggccgcgcactcgatgaagggcaaattagcgccattgtgcatctggtttccagcgccgttgctggtctgccgccgggaaacgtcacgctggtggatcagggcggacatctgttaacccagtccaataccagcgggcgcgatcttaatgatgctcagttgaaatatgccagcgatgtcgaaggccgtattcagcggcgtattgaagcaatcctgtcgcctattgttggtaacggtaatattcacgcccaggtcacggcgcagctggacttcgccagtaaagaacaaacggaagaacagtatcgccctaacggtgatgaatctcaggcggcgcttcgttcacgccagcttaatgagagcgagcaaagcggttccggttatccgggcggcgtaccgggggcgttgtcgaatcaaccggcacctgcgaataacgcgccaatcagcacgcctccggcaaatcaaaataaccgccagcagcaggcgagcaccaccagcaatagtgggccgcgtagcacacagcggaatgaaaccagtaactacgaagtcgatcgcaccattcgtcataccaaaatgaacgtgggcgatgtgcaacgtctgtcagtcgcggtagtggtgaattacaaaaccttgccagacggtaaaccattgcctctcagcaacgaacagatgaagcaaattgaagatctgacccgcgaggcgatgggcttttctgaaaaacgcggtgactcgctcaatgtcgttaactcgccgttcaatagcagtgacgaaagcggcggagaactgccgttctggcaacagcaagcgtttatcgatcagttgctggctgccggtcgctggttgctggtactgctggtggcgtggctgctgtggcggaaagcggtacgcccgcagttaacacgtcgcgctgaggcgatgaaagctgtacagcaacaggcgcaggcccgtgaggaagtggaagatgcggtggaagtccgcctgagcaaagacgaacaactccaacaacgacgcgctaaccaacgtctgggggcagaagtcatgagccagcgtatccgtgaaatgtctgataacgatccgcgcgtggtggcgctggtcattcgccagtggataaataacgatcatgagtaacctgacaggcaccgataaaagcgtcatcctgctgatgaccattggcgaagaccgggcggcagaggtgttcaagcacctctcccagcgcgaagtgcaaaccctgagcgctgcaatggcgaacgtcacgcagatctccaacaagcagctaaccgatgtgctggcggagtttgagcaagaagctgaacagtttgccgcactgaatatcaacgccaacgattatctgcgttcggtattggtcaaagctctgggtgaggaacgtgccgccagcctgctggaagatattctcgaaactcgcgataccgccagcggtattgaaacgctcaactttatggagccgcagagtgccgccgatctgattcgcgatgagcatccgcaaattatcgccaccattctggtgcatctgaagcgcgcccaggccgccgatattctggcgttgttcgatgaacgtctgcgccacgacgtgatgttgcgtatcgccacctttggcggcgtgcagccagccgcgctggcggaactgaccgaagtactgaatggcttgctcgacggtcagaatctcaagcgcagcaaaatgggcggcgtgagaacggcagccgaaattatcaacctgatgaaaactcagcaggaagaagccgttattaccgccgtgcgcgaattcgacggcgagctggcgcaaaaaattatcgacgagatgttcctgttcgaaaatctggtggatgtcgacgatcgcagcattcagcgtctgttgcaggaagtggattccgaatcgctgttgatcgcgctgaaaggggccgagcagccactgcgcgagaaattcctgcgcaatatgtcgcagcgtgccgccgatattctgcgcgacgatctcgccaaccgtggtccggtgcgtctgtcgcaggtggaaaacgaacagaaagcgattctgctgattgtgcgccgccttgccgaaactggcgagatggtaattggcagcggcgaggatacctatgtctgataatctgccgtggaaaacctggacgccggacgatctcgcgccaccacaggcagagtttgtgcccatggtcgagccggaagaaaccatcattgaagaggccgaacccagccttgagcagcaactggcgcaactgcaaatgcaggcccatgagcaaggttatcaggcgggaattgccgaaggtcgccagcaaggtcatgagcagggctatcaggaaggactggcccgggggctggagcaaggtctggcagaggcgaagtctcaacaagcgccaattcatgcccggatgcagcaactggtcagcgaatttcaaactacccttgatgcgcttgatagtgtgattgcttcgcgcctgatgcagatggcgctggaggcggcacgtcaggtgatcggtcagacgccaacagtggataactcggcactgatcaaacagatccaacagttgttgcagcaagaaccgttattcagcggtaaaccacagctgcgcgtgcacccggatgatctgcaacgtgtggatgatatgctcggcgcaaccttaagtttgcatggctggcgcttgcggggcgatcccacactccatcctggcggctgtaaagtctccgccgatgaaggcgatctcgacgccagtgtcgccactcgctggcaagaactctgccgtctggcagcaccaggagtggtgtaatgaccacgcgcctgactcgctggctaaccacgctggataactttgaagccaaaatggcgcagttgcctgcggtacgtcgctatgggcgattaacccgcgctaccgggctggtgctggaagccaccggattacaattgccgctcggcgcaacctgtgtcattgaacgccagaacggcactgaaacgcacgaagtagaaagtgaagtcgttggctttaacggtcaacggctgtttttaatgccgctggaggaagtcgaaggtgtcctgcccggcgcgcgtgtttatgccaaaaacatttcggcagaagggctgcaaagcggcaagcagttaccgctcggtccggcgttattaggtcgtgttctggacggcagcggtaaaccgctcgatggcctcccctcccccgatacgacggaaaccggtgcgctgattaccccgccatttaacccgttgcaacgtacaccgattgaacatgtgctggacaccggcgtgcgcccaatcaatgccctgcttaccgttgggcgtgggcagcgtatgggactgtttgccgggtctggcgttggtaaaagtgtgctgctggggatgatggcccgttacacccgcgccgatgtcattgtcgtgggtttgattggtgaacgtgggcgcgaagtaaaagattttattgagaatatcctcggtgccgagggacgtgcacgctccgtggtgattgccgctccggcggatgtctctccgcttctgcgaatgcaaggtgccgcctatgccacgcgaattgccgaagattttcgcgatcgtggtcagcatgtgttgctgattatggactccctcacccgctacgcgatggcccagcgtgaaattgcgctggcgattggcgaaccacctgccactaaaggttatccaccgtcggtgtttgccaaattaccggcactggtcgagcgtgccggaaatggaattagcggcggcggctcgattaccgcgttttataccgtgctcaccgaaggcgatgaccagcaggaccccattgcagactccgcgcgggcgatcctcgacggtcacattgtgctgtctcgccgactggcggaagccgggcactatccggctatcgatattgaagcgtcgatcagccgcgcaatgacggcgttgatcagtgagcaacattacgcgcgagtgcgcaccttcaaacagctgttgtcgagttttcagcgtaaccgcgatctggttagcgtcggcgcgtatgccaaaggcagcgatccgatgctcgacaaagccatcgccctgtggccgcagctggagggctatttgcaacaaggcatttttgaacgtgcggactgggaagcgtctctccaggggctggagcgtattttcccgacagtgtcataacccaggagataacggcagatggcagaacatggcgcgctggcgaccctgaaagatctggcagaaaaagaggtagaggatgccgcgcgcctgctgggtgaaatgcgtcgcgggtgtcagcaggcggaagaacagctcaaaatgctgatcgattatcagaatgaatatcgcaataacctcaacagcgatatgagtgccgggatgaccagcaaccgctggatcaactatcagcagtttatccagacgctggaaaaagccattactcagcatcgccagcaacttaatcagtggacgcagaaagttgacattgccctgaacagctggcgagaaaagaaacaacgtttgcaggcctggcagacactgcaggaacggcaatccacagcggcactgcttgcagaaaaccgcctcgatcagaaaaagatggatgagttcgcccagcgcgccgccatgaggaaacctgaatgattcgcttagcgcccttaattaccgccgacgttgacaccaccacattgcctggcggcaaagccagcgatgctgcacaagattttctcgcgttgttgagcgaagcattagcaggcgagacaactaccgacaaagcggccccccagttgctggtggcaacagataagcccacgacaaaaggcgagccgctgatcagcgatattcttgccgacgcgcaacaagcggatttactgatccccgtggatgaaacaccgcctgtcatcaacgacgaacaatccacatcaacaccattaaccaccgctcaaacgatgacgttggctgcggtggctggcaacaatacggcaaaagacgaaaaagcggatgatctgaatgaagacgtcaccgcaagcctgagcgccctttttgcgatgttgccgggttttgacaatacgcccaaagtgactgatgtgccgtcaaccgtgttaccggcagagaaaccaacgctcttcacaaaactgacttctgcgcaactcacaacagcacagcctgatgatgcccccggcacgccagctcagccattaacaccgctggtagcagaagcccagagtaaagcggaaatcatcagcacaccttcaccggtgaccgctgccgccagcccgctaatcactccacaccagacacagccactgcccaccgtcgccgcgcctgtgttgagtgcaccgctgggttctcacgaatggcaacaatcattaagccagcatatttcgctgttcacccgccaggggcaacaaagtgcagagttgcgtctgcacccgcaggatttaggtgaagtgcaaatctccctcaaagtggatgataaccaggcgcaaatccagatggtttcaccgcatcaacacgtacgcgccgccctggaagcagcgcttccggtactgcgaacgcagctggccgaaagtggcattcagttagggcaaagcaacatcagtggcgaaagctttagtggtcagcagcaggccgcttcccagcaacagcaaagccaacgcacagcaaaccatgaacctctggcgggggaagacgacgatacgcttccggttcccgtctctttacaagtacgtgtaacaggcaacagcggcgttgatattttcgcctaacgtcagaggtagcaccgtaatccgcgtcttttccccgctttgttgcgctcaagacgcaggataattagccgataagcagtagcgacacaggaagaccgcaacacatgactgattacgcgataagcaagaaaagcaagcgatcgctttggatcccgattctggtattcattaccctcgcggcctgtgccagcgcaggttacagctactggcattcgcatcaggttgccgctgacgacaaagcgcagcaacgcgtcgtgccctccccggtcttctatgcgctggatacctttacggtcaatctgggcgatgcagatcgcgtactttatatcggcataaccctgcgcctgaaagatgaagctacccgctcgcggctgagtgagtatttgccggaagtccgtagccgtttgctgttactgttttcgcgtcaggatgctgccgtactggcgacagaagaaggcaagaaaaacctgattgccgagattaaaaccacgctttccaccccgcttgttgccgggcaaccgaaacaggatgtcagcgacgtgctgtataccgcttttattctgcgataacgacatgggcgatagtattctttctcaagctgaaattgatgcgctgttgaatggtgacagcgaagtcaaagacgaaccgacagccagtgttagcggcgaaagtgacattcgtccgtacgatccgaatacccaacgacgggttgtgcgcgaacgtttgcaggcgctggaaatcattaatgagcgctttgcccgccattttcgtatggggctgttcaacctgctgcgtcgtagcccggatataaccgtcggggccatccgcattcagccgtaccatgaatttgcccgcaacctgccggtgccgaccaacctgaaccttatccatctgaaaccgctgcgcggcacagggctggtggtgttttcaccgagtctggtgtttatcgccgtggataacctgtttggcggcgatggacgcttcccgaccaaagtggaaggtcgcgagtttacccataccgaacagcgcgtcatcaaccgcatgttaaagctggcgcttgaaggctatagcgacgcctggaaggcgattaatccgctggaagttgagtacgtgcgttcggaaatgcaggtgaaatttaccaatatcaccacctcgccgaacgacattgtggttaacacgccgttccatgtggagattggcaacctgaccggcgaatttaatatctgtctgccattcagcatgatcgagccgctacgggaattgttggttaatccgccgctggaaaactcgcgtaatgaagatcagaactggcgcgataacctggtgcgccaggtgcagcattcacagctggagctggtcgccaactttgccgatatctcgctacgcctgtcgcagattttaaaactgaaacccggcgacgtcctgccgatagaaaaacccgatcgcatcatcgcccatgttgacggcgtcccggtgctgaccagtcagtacggcactctcaacggtcagtatgcgttacggatagaacatttgattaacccgattttaaattctctgaacgaggaacagcccaaatgagtgacatgaataatccggccgatgacaacaacggcgcaatggacgatctgtgggctgaagcgttgagcgaacaaaaatcaaccagcagcaaaagcgctgccgacgcggtgttccagcaatttggcggtggtgatgtcagcggaacgttgcaggatatcgacctgataatggatattccggtcaagctgaccgtcgagctgggccgtacgcggatgaccatcaaagagctgttgcgtctgacgcaagggtccgtcgtggcgctggacggtctggcgggcgaaccactggatattctgatcaacggttatttaatcgcccagggcgaagtggtggtcgttgccgataaatatggcgtgcggatcaccgatatcattactccgtctgagcgaatgcgtcgcctgagccgttagtgatgaataaccacgctactgtgcaatcttccacgccggtttctgctgcgccactgctgcaggtcagcggcgcactcatcgccattattgccctgatcctcgctgctgcctggctggtaaaacggttgggatttgccccgaaacgcactggcgttaacggtctgaaaattagcgccagtgcttcgctgggcgcgcgtgaacgggttgtggtggtcgatgtggaagatgcacggctggtgctcggcgttaccgcagggcaaatcaatctgctgcataaacttcccccttcagcaccaacagaagagataccgcagaccgattttcagtcggtcatgaaaaatttgcttaagcgtagtgggagatcctgatgcgtcgtttgttgtctatcgcacctgtccttctctggctggttacgcccctcgccttcgcgcaactgccgggtatcaccagccagccgctgcctggcggtggacaaagctggtcgctcccggtgcagacgctggtgttcatcacctcgttgacgtttattccggcaattttactgatgatgaccagtttcacccgcatcatcattgtttttggtttattgcgtaacgcgctgggaacgccctccgcgccacctaaccaggtattgctggggctggcactatttttgaccttttttattatgtcaccggtgatcgacaaaatttatgtcgatgcgtaccagccattcagcgaagagaaaatatcaatgcaggaggcgctggaaaaaggggcgcagccgctacgtgagtttatgctgcgtcagacccgtgaggcagatttagggttgtttgccagactagcgaataccggcccgttgcagggacctgaagccgtgccgatgcgcattttgctcccggcctacgtgaccagcgagttgaaaaccgcatttcagataggcttcacgattttcatcccttttttgattatcgacctggtgatagccagcgtgttgatggcattagggatgatgatggttccccccgccaccattgctctgccctttaaactgatgctgtttgtactggtggatggctggcaattgctggtcggttcgctggcgcagagcttttacagctagagaggcaaaatgacacctgaatcggtcatgatgatggggactgaagcgatgaaagtcgcgctggcactggctgccccgctattgttggtagcgttggtcacgggccttatcatcagtattttgcaggccgccacccagattaacgaaatgacgctgtcgtttattccgaaaatcatcgccgtatttattgccattattattgccggaccgtggatgctcaatctgttgctggattacgtccgcaccttgttcactaacctgccgtatatcatcgggtagccgtactatgttgcaggtgacaagcgatcaatggctttcctggctaagtctgtacttctggccgttactgcgcgtgctggcgctcatttctaccgcgccaattctgagcgaacgcagcgtgccgaagcgggtaaaactgggtctggcaatgatgatcacgttcgctattgccccatcattacctgccaacgatgttcctgttttttcgttctttgctctgtggctggccgtgcagcagatcctgatcggcattgcgcttggtttcaccatgcaatttgcctttgccgctgtgcgaaccgctggcgaaattatcggtctgcaaatggggctgtcatttgcgacgtttgtcgatccggccagccatctcaacatgcccgttctagcgcgtatcatggatatgctggcgttactgctgttcctgacatttaacggtcatttatggttgatttcactgctggtcgatacctttcacaccctgccgattggtggcgaaccgttgaacagcaatgcgtttctggcactcaccaaagcagggagtttgattttccttaacgggctgatgctggcgttaccgctcattactctgctgctgaccctgaatctggcattaggtttactgaatcgtatggccccgcaattatccatttttgttattggatttccattaactctgactgtcggtatctctttaatggcggcattaatgccgttaattgcgcctttttgcgaacatttattcagtgagatgtttaatttgctggctgatattattagtgaattgccattaatataattccgtaacgtttatcatgttatcctaaggattatccgaaaaataatacctacgaacatcttccaggatactcctgcggcgaaatatttgttttaagctcactcacatatcgcaacatttactttactttaagacaattccaggcaaattatacaacactttacgggatagtaagtccgcctgaaaaatcgcgagagtggcgcattaggtgacccatgttgttccgtttagtcatgatgaaatattcaggtaaggggaattatcgttacgcattgagtgagggtatgccatgtcaacgattattatggatttatgtagttacacccgactaggtttaaccgggtatctgttgagtagaggggttaaaaaaagagaaatcaacgacattgaaaccgttgatgaccttgccatagcttgtgattcacagcgcccttcagtggtgtttattaatgaggactgtttcatccatgatgcttctaacagtcagcacatcaagcacatcattaatcaacatcccaatacgttatttatcgtttttatggcaattgccaatgttcattttgatgaatatctattggtcagaaaaaatttattgataagttctaaatcgattaaaccggaatctctcgacgatatccttggcgatattctgaaaaaagagacaacgataacctcttttttaaatatgccgacgttatcattgagccgaaccgaatcgagtatgttgcgaatgtggatggcaggtcagggaaccattcaaatctctgaccaaatgaatatcaaagccaagaccgtttcatcgcataaaggtaatattaaacgtaagatcaaaacgcataataaacaggttatctaccatgtcgtccgactgacggataatgtgactaatggtatttttgtcaacatgcgctaacacattctgactggtggtttcccaccagtcaggctgaataagattactctgctttctccacaaagataccgtcctgatgccctgcttcattaaagaaccagatgccgagcgggtagtcttccagcgaaaccaggtacattgtgccttcactaaactcctcaactgccagtaccacgccaggacgacgcggaccgccatccgttttgactgttacccgatcattcaccttcatcgttttcctcctgtggctttgtgccagtgtagaacaatttcgtttttctggcagcgccaggcgcgcgcgagtgctgattttctcgacggtctatacttaagagatgccaggcggacttaacgactggcggcaacaacagagtaacggttgcgaggaaagatgatgaaaaccgcaaaagagtacagcgataccgcaaaacgtgaggtcagcgtcgatgtcgatgccctgctggcggcgatcaatgaaattagcgaaagcgaagttcatcgcagccagaacgattctgaacacgttagcgtcgatggacgtgaatatcatacatggcgtgaattggcggatgccttcgaactggatattcatgacttcagcgtctctgaagtgaatcgttgaatgcacaataaaaaaatcccgaccctgagggggtcgggatgaaacttgcttaagcaagaagcacttaaaaaattcgttacaccaggaaatctgatgtgttcatcaccttatccgcaatttttttcgctgacaagaaaatattcgctatatgaatgattaacgctacttatgaatagaaatgtgacgcacgtcaccccttggtggctctggcgtcagcgggatcgctcccgaaaaaatcatctttgataatttgtgctgttttgagaatcatcctggtaaggggagaactgcgcgaccatgttttcaattcaacaaccactactggtttttagcgatcttgatggcaccctgctggacagtcatagttatgactggcaaccagctgccccctggctcagccgtttacgcgaagcgaatgttcccgtcattctctgtagcagtaaaacttcagcggaaatgctgtacttgcaaaaaacgttggggctacaagggttaccgctgattgccgaaaatggcgcagtgatccagcttgctgaacaatggcaggatatagacggttttccacgcatcatctcaggtattagccatggcgaaatcagccaggttttaaatacgctacgcgagaaagaacattttaaattcacaacttttgatgatgtcgacgatgcaaccatcgccgaatggacgggattaagccgtagccaggcggcgctgacgcagctgcatgaggcgtcggtaacgctaatctggcgcgacagtgacgagcgtatggcacaatttaccgctcgtctgaacgaactgggcttacagtttatgcagggtgcgcgcttctggcacgtcctggatgcctctgccggaaaagatcaggctgccaactggattatcgcgacctatcaacaattgtcaggcaaacgcccaaccacacttggcctgggcgatgggccaaacgatgcgcccttactggaggtaatggattacgcggtgattgtgaaagggctaaaccgtgaaggggggcatctgcatgatgaggatccggcccacgtctggcgaacgcagcgtgaaggaccggaaggatggcgtgaagggctggaccattttttctccgcccgttaagcgttatcgctcgcgaatacccgattacgcccagcctgtttagcgagataaagccgacggtcggccagtgactggagttgttcaaaatcataatcaccggtttcctcgctgctacttacccccaacgaggcactgatgcgtatcgtcgtactcttggcaatcaacatctctttttcatttaacttcaggcgaatacgttctgcgacttccgcagcctccgtcagactcgcgcctggcagaatcacacaaaactcctcaccaccgacccgcccggcaacgtcctgcgcacgcaaggaactgctaattaatccggcagcatgagaaagaacacggtcgcccgcctgatgaccaaagcggtcattaatcgctttaaaatggtcaagatcgacctgaatgacagaaaaaggatgttggtgcgtctgacacaatttagcgagcggacgggctttttcgaacagtgcgccacgattatataaacgggttaaggtgtcgtgccacgcctgccactgcaacgagctttgcagaacatacatgttgctgaccatccggcgaatcacataccaggagatgagtaacatggtggtaaagagcgcccacagcagggttaatgcaatgctgatactgccgaaatcgccgcgcacgccttcgcttaacgtatggacgcgcaccagcacaccgtcgaaatggttcagacgttcccagctaacatagcgactgtccatacgaatgccgccccgcgtgtcatgttccattgcctgcgccagcaaggccagttcacgagggtcaaaaatattccctgttggatggtcaggattggaagaggtcaaaaatctcagcttactgtcatagagctgatactcaccatcgaggtttttatcgatggcgtttcttaaaaattgctgcatggtacgcacgggaatactcatccccagcacgccataccagtagttattactgtctaccggaacactgacggtaacctgcggttcagtattgctggcgtgttccggttgcgaagtgaaccagcgtaccgcgcggtgacgattttctcgttgcgaatggccgataaaccagggttgggtgacatagccgtaataacgcgttggtacattgcgcgtaaacaaggtcggctgcgtcgaaacgtaaaatccggcacgcgagacatacatcgcctgtacaaccatcgacgaggtgttgtgcgccagtcgcagcaagtaaccaacttccagtgcagcggtaatttcattgtcgaggctttcattttcgcgagacaggagattcccctcgctgactaatgcatccgatacgccattgactgacagggtgcgtcgtcggttgagttcgatttgccaggcgtgctcgtcgcgatgctgttcgaactcggttacagcatcacgcagagaggtgaaatccagtggcgctacgagagcttcgcgcatgccattacgcaaaaagatcagtttgtcgacgttatactgcaaatgcttatcgagcgcgttggctacgttttccagatgattacgctggctggagatataggcatcttccagcactaccacttcacgccaggtcagcaaggtggaaaaaagcaataccacgataaagcagagattaacgacatgaccaggccccaggcggcgtgcgagttttttcaaccagctctggttttccatttttgtctcgtgctgcaccctgacgactcccaacctgcttttttatgattctggcataacctggcgatagcgtaccgcaaaacagcgataattttataatggtggcatgataagacgcgactatcattcattgcaggcattggcacaccaggccggatgtgatccggcctggtgttaatgataccctttcaaacttcttccgcagaacgactcccctcccccggaacaagctcggtttcatgaaaagcttcccgcttgaccccgtaaccgtcataccaacgacactcaaccataccgctggagtatccagtgacaatcatccgcgggccgccctctttaaccgtaacttcctcactaaccataaagctcatactcgcctccttttttcgagtgaaacttgttcaccttagttgaagatggcgaattttgcataatagcctgtgcgagtattaatgtgcctgaccgcgtattttcgctacggctttcactcccagcaccacgatgccgccgatgataaatccaagaatcagatttaaaacagtcggtaatatcatcgccaccactgcactttgctgcccggcgaaatgttcaatggcgtgatgcagcggcgcaataccatgtaccacaatcccgccgccgacgaggaacatcgccagcgtgccgacaatcgataatgctttcatcaaccagggcgcaatgatcaataaccctttacctaatgcctgcatcagcgcgctggatttttccgccagccaataccccaggtcatcaatcttaacgataacccctaccagaccgtagacgcccacggtcactaccagcgcgatgcctgaaagcaccagcacctgattaagcaacggcgcttcggccacaatccccagcgtgatggcgacgatttccgcagacaatataaaatcggtacgaatcgccccttttattttgtccttttcaaacttcagcggatcctgcgccgccagcttctccagacgctgctggctctgcgccggatcttctttatgtttacgcgcctccagcatatgcagcactttctctactccttcaaagcagagaaacgcgccaccaatcatcaacagaggcgtaatcgcccacgggataaacgcactgatgatcagcgccagcggcaccagaatcactttattaatcagcgatcctttcgccacgccccagaccacgggaagttcccggttggcccgcacgcctgaaacttgttgcgcattgagcgataagtcatcccctaatacaccggcggttttcttcgccgccagtttgcccatcacggagatatcgtccagcagtgtggcgatatcatcgagcaacgtcagtaaactactcccggccaaaagcattccctctcatttttattgttgaagggtgtaagtatgaagcaaaaacggcagctctgatacttgcttcacaggtcaacatttttttaacaatcaagtgcaattatatctctcgccagcagaatgattttcacgtttactatgacccacctttttatttccaccgtgagggattatgcgtttccgccagttgttaccgctttttggcgcgctgtttgcgttgtatatcatttggggctcaacctattttgtcattcggattggcgtggaaagctggcctccgttaatgatggcaggcgtgcgattcctggcagccggtattttattgctggcatttttgctactgcgcggacacaaactccccccgctacgtccgctgcttaatgccgcgctgattggcctattattgctggctgtcggtaatggcatggtgacggttgccgaacatcaaaatgttccttccggcatcgccgccgtagtggttgcaaccgtgcccctctttaccctgtgcttcagccgcctgtttggcattaaaacgcgcaaactggaatgggtgggtattgccattgggcttgccggaatcatcatgctcaatagcggtggaaatttaagcggcaatccgtggggcgcgattctgattttaatcggctcgattagctgggcgtttggctcggtttatggctcgcgcattaccttacctgtagggatgatggcgggtgcgattgagatgctggcggcaggcgtggtgttaatgatcgcgtcgatgattgcaggtgaaaaactgacggcgctcccttccctttcaggcttccttgcggtcggctatctggcgctgtttggttcgattatcgccatcaacgcttatatgtatttaatccgtaatgtcagtccggctctcgccaccagctacgcctacgttaacccggtggtcgcggtcttgctgggtacgggactgggcggagagacgctgtcgaagattgaatggctggcgctcggcgtaattgtcttcgcggtggtactggtcacgttgggaaaatatctcttcccggcaaaacccgtagttgcgccagttattcaggacgcatcaagcgagtaaaagaatcccctgcgtgtcgatctgcgcgctggcaccttcgccgcagatccactcttccagacgctcggtaagcgcttcatccgtcagcttctcgcgcccacgtaatgcacactcccagacaatcagtacgcgccagccgagttcctgcaaacgactgatatcgcggcgatcgcgttcaacatttttacctatcttctccagccagaactcggttcgagtcgcaggcactttaaacagatagcagtgatgatgatgccagaagcagccatgggtaaatatcacgcagcgatattcatcaacgacaaaatccgggcttccgggcagactggcgtcctgaacgcgaaacgccaggccctgcccggttaacagactggcgaggcgcttctcaatcgccgtatcacgcgtggcaatcgcgcgcatatttttgctgcgagtggccttatcgtgaacgtcggccatgttgtgcctcttgctgacgcaacgccaccgcctgtttgatttttggctcaagcagttttgccaccgcggcaaagaccggcacgaccaccgagttaccgaactggcgataggcctgagtgtccgaaaccggaatgcggaatttcgcttctcccggcgcttcaaaacccattaagcgcgcgcattcccgaggcgttaaccgacgtggacgatgttgctgattcagcggatcgtcaaaatctttctcacccgtggccatatcccagccgcgatcgattaaaatttccgcgccatctttgtaataacgcgcagacagcgtacgcgtgacgctttgcggattgttcggataaaccattccataaccgaagccgttaccgcgcgcctgatgttttttcgcatatcgatagaggtacttccacagcaccggcgtcaggatatatttcgcctcgaccatcgggtccaacagctgcgccagcgtcactcgctgtgcagggaaacattcgctgatatcacgcagagtaaaatcggctttcagattaagatcgcgacgaaaacccaccagcacgatgcgttcacggtgctgcggcagaaaatgtttaccatcgatgattttcggatcgtccggcccgttatcttctgcatcagccacgtcatagcccagttcgtccagcgtctgcatgatgatgcggaacgttttaccctggtcgtgacttttcaggtttttgacgttttcgagcacaaacatcgccggacgacgcgcgtcgataatgcgtaccacatcaaaaaacagcgtgccctgggtatcgcaggcaaaaccgtgcgcccgcccgagcgagttctttttcgatacgccagccagcgaaaatggctgacaagggaaaccggccagtaaaacatcgtgttcaggaatgtgttgacgaatatgttccgccgccgcctcatcactcacgccttctttatggctgagggtgatatcgcggatatcttcattaaaatgatgcgtcgccggatcgcaataatggttggctttataagtgcgtaccgcatgtttgttccattcgctggtaaacacgcattgtccgccaatcgattcaaaaccgcgacggatgccgccaattccggcaaatagatcgataaagcgaaacgcataatgcggatgatgtgccggtggtttgggtaacaacgtttgcagatgggcgaactctttctcacttaaacggtgccatgccgagtcattcgccagcgcacgttttaaaattgccgcgctccagtgattctcacccacaccattaagctgcgccaccagcgttttaacatcataaatttgcagcagtttctccagcattgcctgtgcggcattcccggtgctgtatgaatcggttactgatatattttcctgcatagatttaaccggccatctgagatggccgacaggttaacataattacagccatttagggccacgcgcttatcccgcgggtgaaaacgcatctatcaccttgtgatcgacaccttcattctcccccgccagttcggcactgagcttcgccataaactcgactaaaaaatgcgcgttgtgctgcgccagctgcttgcctcttgcggtttgcatggtttgcggtagcttcagcaacttagtctggaaatgatccagcgcgtagcgtttatcatcaagcgggcgatgctgtgcgaacggatcttcaccatcaaacagcgccacgcccaatgcccctgaaacggcaaacacgcgcgccaggccaatcgcccccagggcttccagccgatccgcatcctggacgattttagcttccgttgttaagggggcgatttgcgcgctgaaactgtgagcggcaatggcatgacaaacggcctcgattttctccgccggaaattgctcgaactcttcacggagcaggcgacgcgtctcttctgccgccaggattgaagaacgctgcctttgcggatgatttttcgccaggctcacaatatcgtgaaaataacaggcggttaaaatcaccagcatatcgacatcgtcatctgccgccagcttctgtgccgtagcccagacgcggcgaaaatgacacacgtcatgggccgcgtcctggtgctgatgatggtttttcaaccagttttcgaactgtgcctgccagtgttgtaagtccatacgcgctccgttgccaaagagtcgccaccttagcagtttttattcatagcgtctgctacgtgcaggacgaggtcgggtgtaccaggcaatgctgcctaacaatgccccgaccagagccataaataaaaatccgaccagtgcccctaaccactttcccgcggtagagcctaaatcgctttcaaatcccgacacgggggcatcggggatccggctcatcacccagatgtaacgcgccattgcccagacgaaatagccacaccatgtatagaaagcccacaaagccggtttgccgccagggctgcgagagagtctctcttccatctttgtcgaaccgtattccattttgagataacccggaaaattcagacttagtactattatgtgataaaagtcacatttttccacattggatgagccagtcaagactcaatcattttttgaacaaatagataaattttgcgcaacggcagtgaatacaggaaaaatcgttttgagcgattttatttatctttgatatcggctttattaattcatttaatcaatatattagcactgattacaattatacctttttattattctgtgtcatgatgcttccgttattagccttttatcgtcttgtttatattttttgggccggcatgatgccggcttttttttataccttcattaatgtgcgcctgatcacaccagccgtttggcgcaacaatcattgataccccctatgtttccgctcaactcataacatattgatatacatttataatttcatgaatatttatatttagaattcataattctgaattatattaaatagattagaaacattttgaaatcttttaaatacatttgttacatgtaacccttaaaataaaatgaacttcatagaatagtatccaaatgtgctttttttggataacggcacttattgatatattcatgaagattataatcacaagggaatacataatgaaaagaaaagttctggcaatgctggtcccggcgttattagttgctggcgcagcaaatgcggctgaaatttacaataaagatggcaataaagttgatttctacggcaagatggttggcgaacgcatctggtcaaatactgatgataataacagcgaaaacgaagatacctcctatgctcgtttcggtgttaaaggtgaaacccaaatcaccagcgaactgactggttttggtcagtttgaatacaacctcgacgccagcaagcccgaaggctctaatcaggaaaaaacccgtttaaccttcgcaggtttgaaatataacgagttaggatctttcgactatggtcgtaactacggtgttgcttatgatgccgcagcttataccgatatgttagttgaatggggtggtgattcctgggcttccgctgacaacttcatgaacggtcgtaccaacggtgttgcaacctaccgtaactctgatttctttggtctggttgatggtctgaattttgctgtgcaatatcaaggtaagaacagcaatcgtggcgttactaaacaaaacggtgatggctatgcgttgtctgtagactacaacatcgaaggttttggttttgtaggtgcatatagcaaatctgatcgtactaatgaacaagctggtgacggctacggtgataacgctgaagtgtggtcattagcagccaagtatgatgcaaataatatctatgcagcaatgatgtacggtgaaacccgcaacatgaccgttttggctaatgatcattttgcaaataaaacccaaaactttgaagctgttgtacagtatcagttcgacttcggtttacgtccgtctttaggctacgtatattccaaaggcaaagatctttatgctcgtgatggacataaaggtgttgatgctgaccgcgtaaattatatcgaagttggtacctggtactacttcaataagaacatgaacgtctacacagcatacaaatttaacctgctggataaagacgatgcagcgattaccgatgccgcaactgatgaccagtttgcagttggtatcgtctaccagttctaatcagccaacgcgccgcggcgtgttactgtaaaacttaacactagcctgagttcgtccctcatcgaactcaggcttttttattggcattttatctccctctgcggcacgcgcaattgccaaagcatatcgatacagcaccttaccctgcccctgctggcacaataacatctaccagcgactcttccagccaagacccaaatgcatttctttatgaattaatctgcaacaaaaccgcctcccatatagaaatatttgcaaaaatagtgcatgaaatacgctttttctctaccaatccgggatataaatattcatcagcaccacaatattccacagcactaaatctctccccgtcgccccgtacctctgataatggtctaaaatcattgaggccacttgcgacgacgttgctcaataaggaaaatttggcgtgaataatattcaacaccagtgcagcatcatcattacatacttacacccgccgacgaccgctttcgatatattgactcaattttccagcctggttaaaaatagcgaccagctcagtcgcaaatatagtgactaccctaactaagcaacaataaggaatacactatgactgttcaaacaagtaaaaatccgcaggtcgatattgctgaagataatgcattcttcccttcagaatattcgcttagccaatataccagtcccgtctctgatcttgatggcgtggactatccaaaaccgtatcgcggtaagcataaaattctggtgatcgccgcggacgaacgttatttgccaaccgataacggaaaactgttctcgaccggtaaccatccgattgaaacgttgctgccgttgtatcatctccatgctgcaggtttcgaattcgaagtggcgaccatttccggtctgatgaccaagtttgaatactgggctatgccgcacaaagatgaaaaagtaatgccattctttgagcagcataaatcgttgttccgcaatccgaagaaactcgcggatgttgtcgccagcctcaacgctgacagcgaatatgcagcaatctttgttcctggtggtcatggcgcacttattggtttaccagaaagccaggacgtagctgctgctttgcagtgggcaatcaaaaatgaccgttttgttatctccctttgccacggcccggcggcttttctggcgcttcgccacggcgataacccactgaatggttattccatttgcgcattcccagacgccgcagacaaacaaacgccagagataggctatatgccgggtcatctcacctggtacttcggcgaagagctgaagaaaatgggcatgaacattattaatgacgacatcaccgggcgagtacataaggaccgtaaagttctcaccggcgacagtcctttcgcagcgaatgcgttgggtaaactggcggcgcaggaaatgctggcagcttatgcgggttaatccctgttacgtatgaatgtaagcgcataatcaatcgcagccacgttaatactcacgacgtggctgcgttttttcatggttgatttatggcgtactgaagccctatgttaatttctttgcggtaacataatccggaacacattatgcttattgagatagtgatacgtagcacttcccccatgtaattcggcaatcgctttgactaaagaaagaccaagtccctgacctacggaatgacgcgaattatctccccgccaaaatctacggaagagtttttcaggctcatgaattttcgttccaggactggcgacatcaatattaagatagccgttggtatcaagaaaactggttatctcaatacgcgatttttctggtgaatatctaatggcattaacaataagattcgataacattcgttgcagtaaaattttatccgcaaagatttgctgattgcactcgaccttaaagcaaatctctttctcgtctgaaaggtattcaagataatccaacaaattttcgacttccttattgagagaaagcgagtccagtttcaccaaaacattgtttttatctgcccgggcaagaaacagtatgttctctgttaaccgcgaaatattttccagctcttcaatgttaccggcaattgttttttgatattcagcgatacttctggtttgactgagcgtaacctgattctgacccagtaatgcattaatgggcgttctaagttcatgagcgagatcgtcagcaaattgacttaggcgttcaaaatctttgactaaagcatgatgcattttattcaacgcctgcccaagaggttttagttctctcggtaatgcgctaacctcaacaggctcccggctatcgttataattcagcgcttccgttacaccactcaactttttgatctctcgtaaccccgttcggattaacagcggacttaatactgagcacagtataatggcgacaatgcaaattataatgctattgattttatactgttcaagcatgttatgtctggctgaagccaatttagccacagtaaccgttaatgatggcgaaacttcatcaatattaattcgtaaagcatctatctctgtatcattaataatgcttctgtaaatgccagctgcgctgattgtctcactagcaggtatgttatttaacatgccatcactgacatttgtccggttaacaattttattgatgctatcaccatgaatgatcaagatatcctgactaacatccatcatccggttaaagtacacaggtaacgtatctggatttaccccatcaattaacaactgcttgatctgtgctgtccggttaatgagtgttgtatcatcgcgccatttcaactcacttgccaggccattatagagagtccagacaattccagcaccagcaacagacagtagcaatataaaaagcaaggttaaacggacggttatagacaatcttttcattatttttttaccgctacgaacgaatatcccatcccccggattgtggcaattagcttttcaggaaaaggatcatcaacttttgcgcggagcctgcgaatggcgacgtccaccgtattggtatcactatcaaagttgattccccaaatttcactcgcaataaccgttctgggtataatttcgccagctctggaggccagtagccaaagtaactgaaactccttgcgcgtcagtgtaatactgatattgtccctgctcacactttgactaacagagtccattcttaagccgctgatttctaatgttgaattcaaagcgtgatgttgccttaattgtgcccgaacccttgccagcaactcagaaaatgaaaaaggttttaccagataatcatttgccccactgtccagccctctgactctgtcatcgacagaatcccttgcagtaaggcaaataacaggggtttgctttgctgttcttaacgtttgtaagatctgccagccatccatacccggaagcataatatccagaatgatcaatgcataatcatccttcagcgcaagataaagcccatctctgccatcagaaacggcatcaatgacataacccgcttcggaaagcccctgcgttacccactcctgggtcctttgattatcttcaataagtaaaatcttcatgaaaataatatgccataaatcatatgttatagaaacagcctggttcattacaaaattgtaatgctgctgtaaggttaccctggacgctttttcgctatcctcaaaactcattcacatgacaaggatataaacatgttaaagcgttatttagtactctccgtagtaacggctgcattttcattaccttctttggtctatgctgcacaacaaaacattcttagcgtgcacattttgaaccagcaaacaggaaaacccgctgccgacgtgacagtcactcttgaaaagaaagcggacaacggctggttacaacttaataccgccaaaacagataaggatggacgaattaaggcactgtggcccgagcaaactgcaactacgggcgattaccgtgtcgtatttaaaaccggggactatttcaagaaacaaaatcttgaaagtttcttccctgagatccccgttgaatttcatattaataaagtgaacgagcattatcatgtgcctttattacttagccaatatgggtattcaacctatcgtggcagttaatgcataaatatgtaaaagcagatctctgctactgttagggaggacactccctgacagattaacagtaaacggctcttgctggctaacgacaaaaaagtgtgatggcttatgaaaaagaatcaatttttaaaagaatcagatgttacggccgagtcggtattctttatgaagcgtcggcaggtgttaaaagcactgggcatcagcgcagctgcactttctttgcctcacgctgcgcatgccgatctgcttagctggtttaaagggaacgatcgcccacccgcccccgccggaaaaccgctggagttcagcaagcctgccgcctggcaaaataacctgccactgacgccagcagataaagtttccggctataacaacttctatgaattcgggctggataaagccgatcccgccgctaatgctggtagcctgaaaaccgatccatggacactgaaaatcagcggcgaagtggcaaaaccattgaccctcgatcacgatgatttaacccgtcgcttcccgctggaagagcgtatttatcgtatgcgctgcgtggaagcgtggtcgatggtggtgccgtggattggttttccgctgcacaaattgctggcgcttgccgaacccaccagcaatgcgaagtatgtcgctttcgaaacaatttatgcaccggaacagatgcctggccagcaggaccgctttatcggcggcgggctgaaatatccttatgtcgaaggattgcgtctcgacgaagcaatgcatccgctcacactgatgaccgtgggtgtttatggcaaggcgttaccgccacaaaatggcgcgccggtacgactgattgtgccgtggaaatatggctttaaagggattaaatcgatagtcagtattaagctgacccgcgagcgtccgccaaccacctggaatctggcagcgcctgacgaatacggtttttacgccaacgttaatccgcatgttgatcacccacgctggtcacaggctaccgaacgatttattggttcaggcggcatcctcgatgtacagcgccagccaacgctactgtttaatggttacgccgaccaggtggcatcgctgtatcgtggcctggatttgcgggagaatttctgaatgcgtctgacagtaaaacaggtgacatggctgaaagtttgcctgcatcttgccggattgttgccgtttctctggctggtctgggcgatcaatcacggtggactgggtgccgatccggtgaaagatattcagcattttaccggtcgcactgcactgaaatttttgctggcgaccttgttaatcacacctctggcacgctacgcaaaacagccgttattgatacgcactcgccgcctgttaggcttatggtgctttgcctgggcgacactgcatttaaccagttacgcattgctggagctgggcgtgaataatctggcgttattaggcaaggagttaattacccggccttatttaacgttaggaattatcagctgggttattttgcttgctttagcgtttacttcaacccaggcgatgcagcgaaaactcggcaagcactggcaacagttgcataacttcgtctatcttgtcgcgatcctggccccaatacattatttgtggtcagtgaagattatttcaccgcagccactcatctacgctgggctggcggtactgcttttagccttacggtataagaagttgctttcctttttcaaccggttacgcaagcaggttcacaacaaattatctctataacttcatattgccgacaaagtacgcgttatccctgccggatgcggcgcgagcgccctatccggcctacgcagatcacatcaggttatgtttcgtttgtcatcaacctcaaattatcaacataattcattttatttcaataagatagataagtacacctgagaaaactatgctctcatctcctaagagttgttgcattttgtcatatgttacaatataacattacacatcatatacaatgactctggaggaaactgttttggcgattcgtcttcacaaactggctgttgctttaggtgtctttattgttagcgctcctgccttttcgcatggtcatcactcacacggcaaacccttaacagaggtcgaacaaaaagctgctaatggtgtttttgatgatgccaatgtacaaaaccgaacgctcagtgactgggatggagtctggcaatccgtttatcctttactgcaaagtggcaaacttgaccccgtctttcagaagaaagcggatgcagataaaactaaaacatttgctgaaattaaagattattatcacaaaggttatgcaacagatatcgagatgattggcattgaggacggcattgttgaattccatagaaataatgaaacaacatcctgtaaatatgattacgatggatacaaaatactcacctataaatcaggcaagaaaggcgttcgttacttattcgaatgtaaagatcctgaaagcaaagcccctaaatatatacaatttagcgatcatataattgcaccacgaaaatcatctcattttcacatttttatgggtaatgattcacagcaatctttattaaatgaaatggaaaactggccaacgtattatccatatcagttgagtagtgaagaagtggtcgaggaaatgatgtctcattgagtattctcatgataacgcctcgatgccgctttagtaagtcatcataactgccactggtccatccacaaacgccactgaacgcaagctaactacagacacgctcatcactatgacgtgtctgtatattaataagctaacccgcattgagttaaccaataacggattccatacacaatacggccaacagagaaagatacctgtgctcacgccattgcttatattggctggttacaatgtgcactatcaattttttaaataacaaattcttaaaaccacatctgtataaggaatttttaaggttcgtgggatagcttgactgtgaaaattacaggagctacaaaaatgaaccgattctcaaaaactcaaatttatttacattggataacgctgcttttcgttgcaataacctatgccgcgatggaactccgtggctggtttcctaaaggtagtagtacttatctgctgatgcgagaaacacattacaatgcgggtatattcgtttgggtgttaatgttttcacgcctgattataaaacaccgttatagtgatccttctattgtgccaccgccacctgcctggcaaatgaaagcggcttcgctaatgcacatcatgctttatataaccttccttgcacttcctctgctggggattgctttgatggcttacagtggaaaatcgtggagtttccttggtttcaatgtgtctccctttgttaccccaaacagcgaaattaaagcactgataaaaaatattcacgaaacctgggcaaatataggctactttttaatcgcagctcacgctggcgcagcactctttcatcactacattcagaaagataatactctgttacgaatgatgcctcgccgcaaataagtcgatcccctgacaaggaaatgtgaaccatggacatcaacgcgtcataaatgtttacgcaagtgcacaatgcaccctttccactatcaacaaggaggagcagaaactgtgtaaatcgtacaatggtaagacttatcaaaaatacaggttaattttggtatttaaaccttttttacttgttagtatgatacaaaggctttcaaaaaagctgggaaattcaacaactcttggaaattatggactttgtcccgcggctttaatctgacggccgcgttccttttttgactcaattattgaacccttctctacgcaacttcagttcccaccaccaactttgcggcagtttcataggatgaatgtctaaaagaataatggtgagcgataagaaaacgactgaataactgcacattttcgctcgaaagcttcctgtcagatccatagcgaatcaagtgctgaatgtcacagtatcgaacagaaaacagtgacgatctaacccttcaagaatattctacgattgttctgtttaggaaaagcaaggcgggaagtcgggagataagtcattgataaagtggcggagagagggggatttgaacccccggtagagttgcccctactccggttttcgagaccggtccgttcagccgctccggcatctctccgttcagatggttgccatgatgccaggaaatttggcattttaacagtccctgtccgtgcaattttgttcaagtgacgagtttgcgagcaaaacgatgattaagtggccctggaaagtacaagaatcagcacatcaaactgcccttccctggcaggaagcactatcgatcccccttttaacgtgtctgacggaacaggaacaaagcaaattagtcactcttgccgaacgttttttacagcaaaagcggcttgttcctttacagggctttgaactggattcattaagaagctgccggatagcacttctattttgcctacccgttctggagttaggactggaatggctggatggttttcatgaagtcttaatttatcctgcgccatttgtggtcgatgatgaatgggaagacgatatcggtctggtgcataaccaacgtattgttcagtcaggtcagagctggcagcaagggcctatcgttttgaactggttggatatacaagattcttttgatgcttctggttttaacctgattattcatgaagtcgctcataagctggacacccgtaacggcgatcgcgccagcggagttccctttattccgttgcgtgaggttgctggctgggaacacgatcttcatgctgcaatgaacaacattcaggaagaaatcgaattggttggcgagaatgcggcgagcattgatgcttatgcagccagcgatcctgctgaatgttttgccgtactttctgaatatttctttagcgccccagaactttttgctcctcgtttcccttcattgtggcaacgtttctgccaattttatcaacaagatcctttgcagagactgcatcacgctaatgatacagactcgttttcggcgacgaatgttcattaattaacaactttgcagattaattaaccaattgaaatgacttatgaaatttagtgttgacagacaaggtaccgctaagtaatattcgccccgttcacacgattcctctgtagttcagtcggtagaacggcggactgttaatccgtatgtcactggttcgagtccagtcagaggagccaatttgctgttttcatgcatccttgcgaatcattatatgatgttggttcaacaggttagcgtgaaaactcttcccggtgcattttgattttaccctccgcatcgggaaaaattggtggtcaaatctggggtcaggttagttcgataatggagcgacccccatatgtcccttaccgacgcgaaaatccgcactctcaaaccttctgataaaccctttaaagtctccgattcccacggtctgtatctgctggtcaagccgggtggctcacgtcactggtatctcaagtaccgtattaacggtaaagaatcgcgcattgcgctgggtgcctatcctgccgtctccctctctgatgcgcgacagcagcgtgaaggtgtccgtaaaatgctggcgctgaatatcaacccggtacagcagcgggctgctgaacgtggctcacgaacaccggataaagtttttaaaaacgtggcgctggcgtggcataaaagtaaccggaaatggtcgcagaacaccgctgaccgtctgcttgccagcctgaacaatcacatctttccggtcattggcaacctgcctgtatcagaacttaaaccccgtcatttcattgacctgctgaaaaggatcgaggaaaaaggtctgctggaagttgcgtcccgcacgcggcagcacctgagtaacataatgcgccatgcggttcatcaggggttaatcgatacgaacccggcagcaaatcttggcggcgtgaccacacctcctgtcagacggcactatcctgccctgccactggagcggctgcctgaactgcttgaacgtattggggcatatcatcagggtcgtgaactgacgcggttggccgtcctgctgatgctgcatgtgttcattcgctccagtgaactgcgtttcgcccgctggtcagagattgatttcacaaaccgagtctggacgatacccgcgacgcgagaacccattattggagtgcgttattccggccgcggggccaaaatgcgaatgtcgcatatcgtccccctctcagaacagtccatcgccattctgaaacagattaaggatatcaccggtaataatgaactgatcttccccggcgaccataacccgtataagccaatgtgtgaaaacacggtcaataaggcactgcgggtgatgggctacgacacgaaaaaggatatctgcggtcacggcttccgggcaatggcatgcagtgcgctgatggaatcgggtttatgggcaaaggacgcagtagaacgccagatgagtcatcaggagcgcaataccgtgcgcatggcttatattcataaggcagagcacctagaagcccgcaaagcgatgatgcagtggtggtcggattatctggaagcatgccgagaatcttatgcaccgccttatacaattggtaaaaataagtttatcccatagtatactaacgaatcccacactctggcaaattaccaccacctctacaggaggtggttctatatagacttttatcaacttcatgacgaaaaacacctattttatccaaaaagaagacaatagagtcacagaggaatcaaagagcgactcaattgtctttggacagtctggttgtgaggttagaaaacagttactcctacaccattaaatagggcgcaatgctcgctaatttctcccgggtttccgtcagttcgcgttccggtgtagattgcgcgatgattcccgcccccgcttgtatccagcagcgctggctgtcctgaaatacggaacgcagaactagcgccgcatcgaagcgcatatcgtccagcagcagaattgcgccggaatagagctctcgcggcgtcttctcaatttgcataatcgcgttcagggcagcgtttttagggatacctgaggcggtaatcgacggaaacagcacggtaaacgcatcccaggcatccttgttttccgcaagctgaccgctcacgccggaccccagatgctgaacgctgccgcgctggcgaaccgacattaaatcttcaaccaccacgctgcccggcaggcaaacggcctccagttcagcaatcgcttctttgacagaaaggatatgctcaagcacctctttactgtcgtgcagcagttctgcctctttcgccttattatgctccgggtttcccatgcgatcgcgggtgcccgcaagcggttcagtgaccactttattgcccgtcactgacatcaccagttccgggctaaagcccagcgcttcgcgtccttcctgacggaacataaacgagcgcacaggtgtatttgcctgccgcccgtataacagcgtggcgggcatatcaatccgcgatggcaggggaatagcgcgcgagacaatcactttgacatactcgccacggcggatctccgcaacggcgcgtgcaacctgttgtttatacgcctcgccattgagggcggtatccaccgccagtggtgcgttctgcgtcgttgtactggcctcttttacccactcacacaaacgtcggcccccgtcggcggagtccgcataaacggtgacatttcccttttcaaaaataagttcttcacggggaacggttaacgtcagcagcggccactccccggcgttaaaggcaatcccccgcgcatgcgccgcaaagttgaacccaacctgtccataaacccgacgtcctttcacctgaggatgtgccataaaacgacgcgcgcagtcggtaatggaatccaccgcccattgttgctccccggcatcatcaataaatgtcgcctgcgttccgtcggcattaatgtgcaaccgtgccaggcaccctttgcctaaataccaacagggttgacgctcatagacataacactcttcttctgcgaactggcgtaaaacgccagaaatcgtcggcagccattgttcctctggtaacgccaggtgtaaaaattcactgattttcatcccttacctctctgtgttattcccggatcaatcaattgcgcttgtcatcagttctcttgccgaatgcagccggatataagcaacccacgccgccagcaacgtgaataccccggcaaacaggaagcaggccgcatagccaaaatgttgagcaacaacgccgccgataacaccagccaggatggcgattgccgcgtcagtacattgaaagagggtgaagtcgacaccggcctgcaaaggcgatgaaagcgacatcagcgtggcgtaaagacagaccagcgcgcaggccagcgaaatggactggacaatgaccagacactggagaatcggcagcaacagatgacccggcgccatcatgaacgtcatcaccaccgccagcagcgcgatcccctggacgccataagccgtcaacagcgctctgccgggtgaggtgtatttcatcagtaatccgccggccagcgttcctgctatgcccgctgcaatattgccgccgctgaacagcgcgcccaacgcagacatgctcaacccatgatccaacaacagcggcgccagaagaggcagcacaaaccgcatacctgaattcagcattaataccagcagtaagcccaggcgcgcctgcttcctccttagcgcataacctaacgccggaacatgcgggataggcgctgttcgcgtcggctccgtaatgcgccacagcgggaatgacagcgccataatcagcatcgccatcatcagcatggcgacaggccagccggatgctgccgacaacattaggaacaccccgccgccgcacatcattcccagatagctgccgccgacctgcacgctgtttccccagccgtaacccgcgcgagtcagttgatcgacgcaaaagccgtcgctggcgatatcaatggtggaagcgaccgtgcctgccaccataaacagaacaaataacgcgacgatttgcgtatcgggaaatcctccttctcgcccaaaccagccaatcgctgcggcaatcatcaggatcgccgctagcgcgacctgaccacgcaggattaacatccgcgaacggcgttcctggctaccgggcggaagccgccagcgttcgatccacggcgcccaaataaacttcagcgcccagggcagcatgaacagggttgtcgcaccggcaagcgccagcgatccgccagcagcgcgcaccagcgcgggtaaggactgcatagacagcgccgataccagactctgcgtcacatagacgccggcaatagcaaaaatcacccgcccggtcgtcaacgtcagcggtttcacattcgactgaacatcactcatgcacccactctccagacgcggaaaccccgtcgtcgcgccacacgcgcgcggccatttgcgcctgccacagcgcctgataacgtccatgatgtgagagcaattgtgcatgagtaccctgctcaaccacctgtccctcttccatcaccagaatgtttccggccccggcgatggtggataaacggtgagcgatgataatcaccgtccggttgtgaaccaggttatcgatcgctttttgcaccgccagctcgctttcaatatccagcgcggcagtcggttcatcgagaatgacgaccggcgcgtttttcaataacgctctggcaatggaaatccgctggcgctcgccgcccgatagctggccgcccatctctcccattggcgtcagccagccttgcggaagacgggaaataaactcaaggcactgcgccgcgcgggcggcctcttctacctcctgccgcgtcgcctgtgggcgcgcgatacggatattcgccagcagcgtgtcatcaaacagccagacatcctggaaaacaacagaaatcaggctattgagctgttccggcgtcaggcggcgaatatcgacgccgccaatagaaatctgcccttgctgcggatcggcatagcgcattaacagtttggtgaccgtagttttgcctgcgccggaggcacccaccagcgcgctcatactggctgccgggaacgtcaaagaaacatgattaagcgcgtggccgtcgccttcttcgtagcgatagctgacgttgtcaaagcggatatcgtaacgttccggcatctcgctttgctctgcgacgggaagcggtgctatcgccataaaccgctcaatccgttgcagggcgctggcgatcagttccacaaccgaggtgtagctgataaacatcgccatcggttctgcgaagcgcataatcatcgcgacggcggcaatcaaaaaggcgaggttcagagtgcccgtcactacccagacgatcccggataacaccaccacctgtaggcccaactccacgacgctggcgatcagcatcgtcgcgccagcgccctgacggtgagtgcgggtctgtaagttttccagcgcattgaaatgcgccagcagcgcccggcttttatcggcatcgctgccgcaggtgcgcaataccatcatcccctgagcaaattcaacgatatcgccgctcagacgctggtgcgcttcccccagcgtctgcatttgtcgccgcatcgccgggcggcgccagtaataaaacggcaccagcagagggaagatcagcaacatcaccagccccagccgccagtctatccacaatgtcgccagcgacgccgtcagcggcgtgacaatggtgagcagcaaaatattggctatcgcaataacataattgaggttttcatccacgctgcccagcagcaaggcgttcatttcacccgccctgccgcgctggagcttctccagcggcacgcggcgtaactgctcgccaagtcgcaggcgcaactcatgggtggcctgcgccagatgaccacggtattcaaagcccaggccataccagcgtagcaccagcgtcacaattgcggcgacgctgaaggccatagcccagttaagaagttgcggcgcgtctccccgtaacagcgcatcaatgatcggataaagacaggcaaaggcgatcccctgcatgaatgccgccagcaacagcgccagcatactgcgtcgcagcatcctggcctgactgccaacgctggagataagctggcgccagttgacgcgccaggccaggttatccgcaggattattgtctttcattttccaccacctcttcctgtgttccacccggcacccaatgctgcgcctgctgatagtgttgccagagccgttgatacaggccgccctgcgccaacagttgcgtatggttccccatttccctgagctgtccgtcggaaaacagcaatatcacatcggcctgagtcaccattgagagacgatgcgcgaccatgatgaccgtccggccacgcatggccgccgcgagcgccttgataagcgccgcttcgttttccgggtcagcaaacgccgtcgcctcatcgagcaccaggatggggcgatcctgcaaaagcgcccgggcgatagtaatgcgctgccgctggccgccggagagaaataccccacgttccccgactcgtgtgttgtaaccttctggcagagcgctaataaaatcatgggcctgcgccactctggccgccgctattaccgcctccagcggcgtatccggcgcgcccagacgaatgttattggctatcgtgtcggcaaaaaggaagttgtcctgagacacaaacgagagttgcttcatcagggtgtccgtctgcatatcacgcagatccacgcctccaatacggatatggcctttgtccgggtcggcgtaacgcagcagcaagcgcgccacggtgctttttccggcgccgcttggcccgaccagcgccacaatttgcccggcaggcacatgaaagctcacctcctgcaacgcggcgccagtacgcgcttgcggataatgaaagctcacctgctcaaaggtaatgctcgcctcttgcggctgctggtcagactgcggcagcgataactccggcatcgcgagaacctgataaatacgctgaatgcttaaacgcgtttgcgcgaccaggttattgagcatcatcattggcattacggcttcggccattccgctgcccagcagtaaaacggccacccacgcgataaaatcgaaactgccatagtgcagcaggccgtatcccgaccagatcaggacaaacagggtcgggagaggattcagaatcgagaaggaaaaacgcgctgaaaaaccggctttgcgataccaggttttgagcacatcgacccactcttcaagggctcgttgatagcgcaaaaaactggtgctgccgctatcaaacgttctcaccacgggcatggcctgcacgaactcaatcaccgccgcgctaacctgctcgcgcgccttatgataacgctgagccatatcttccgaacgctggcgggcgagcacgagaacaaccgatccaaacgccagtacccccagcgtcgcgattgccagccgccagtccagccagaacaagataacgattgtcgccagcggcatgatgatcgcgcgggcatagagcggcgtgctgtcggccacaaaaatatgtaacgacttcacgtcatccagcatcactttcgccactgacccgctgcccatttgctgtaacacgccaggcggaagctgcaatgctttacgggctaacctgctgcgcagaatgttctccagatgaaaagccgcgtaatgagaggtgttgaacgcctgtaagcgcagaacaaaagttaagaccacgcagccgatcacgccgcccagcggccaggccggaatagcgtcaggcgtcgcgcgaatgtcacgcaggctccacgctagaaaaaggagcgcccccaggctggttaatgccgccagccccgccagcgccatagctaaaataaccttcctgcgaaccggtgtaatcacctgccagagaggaaatcgggacagcgattcagtattggatgattgagatgacatgggagtaactgaatttcctgatgaatttttacggacgccaaaaacgacaattcagggtggcgttctgagaattaatgtgaataataaccattatcaataactcatctaccccattcggttctatttatacccgcattggtctaagccacagggagataaccaggtcatgacggagtcaccgcaaacgcaatctgaaatctctattcaccagttggtggtcgggaaacctgcaaacgatggcaatattcctgctcagtgtgaactgctgcgctgttcgttgcaggaaggtatggatattttgctctggaggggccattttgcgcggcctgagacgttgcagctacacgacgatctgggcaggattaacttctcgtgcatcctggaaggcacatcgcgttttgcgattcagggactccggcgccacaccgactgggagcttgcgcgcaatcgccattacattacccatacgccagactgtcgcggcagcgcctcctattgtggccgattcgagagcattaccctctccttcagccctgcaaccctcgcgctgtgggtgccggatattagcgcggacattaagaataagatcgactcccactgctgttgccagcagcagcgttgtaatgctgaaacccacttaacggctcaggccttgcgtcacgcgctgatgcgcatgcacggcggcttcagtcatgaacaaaagccgtcgacgctatggttgcaggggcaaagtctggtcatgctcagtctggtgctggatgaacatcgcgaagacgccagttgcctctcctgccacttcaacccgatggaacgccagaaactgctgcgggcgaaggatctgctgctggctgatctgacgcaagcgccgggcgtcgcggagctggccagagagtccggtctgagcgttctcaaaattaagcgaggcttccgcgttctgttcaacaacagcgtctatggcctgtttcaggctgaacgaatgcaggaagccagaagacgcctggccaacggcaatacctccgtcatgacggtggcggccgatctgggctatgccaacgccagccatttctctgccgccttccagaaacagtttggcgtaaccccttcgacctttaaacgcgtgatgtaaccggggtcgcgcccccctaaactcctccctgacagaggcccggataccccatccgggcctctgttctttccgcctgttaccaacccgaaacgggcataaataaacccgtttagggtagcatccaattgttaataattattattctcatatgagcaatgcttttcggtaagacgtgccatcaggaggaagaatgatttctggcgcaccatctcaggattcgctgttaccagacaaccgccacgcggctgattaccaacaattacgcgagcggctcatacaggaactgaatttaacgccgcagcagttacatgaagagagcaacctgatccaggccggcctggattccataagattgatgagatggttacactggtttcgtaaaaatggctaccgccttacccttcgcgagctgtatgccgcccccacgctggcggcatggaaccagttaatgctcagccggtcgcctgagaacgcggaagaagaaacgccgcccgacgaatcatcctggccgaacatgaccgaaagtacccccttcccattgacgccagtacagcacgcctacctgacgggccgcatgccggggcagacgcttggcggcgtgggttgccacctgtatcaggagtttgaaggccattgtctgacggcgtcgcagctggagcaggccatcacgaccttgctgcaacgccacccaatgctgcatatcgcctttcgccccgacgggcagcaggtctggctaccgcaaccttactggaacggcgtcaccgttcatgatttacgccataacgacgctgaaagccgccaggcctatctggacgcactgcgccagcgcctgagccaccgtcttttacgcgtggaaatcggcgaaacgtttgattttcagctgacgctcttgccggacaatcgccaccgcctccatgtcaatattgacctgctgattatggatgcctccagctttacgcttttcttcgatgagcttaacgccctgctggccggagaatcgctgccggctatcgacacccgctatgatttccgctcgtatttgctgcaccagcagaagatcaatcaaccactgagagacgacgcgcgcgcttactggctggcgaaagcatcgacgcttccccccgcgcccgtcttgccgctggcctgcgaacccgccacgctacgtgaagtccgtaatacccgacgccgcatgattgtcccggcaacacgctggcacgcctttagcaaccgggccggcgagtatggcgtgacgccgacaatggcgctggcgacctgtttttctgccgtgctggctcgctggggcggcctgacgcgactgctgcttaacatcaccttattcgaccgccagccgctgcacccggcggttggcgcgatgcttgccgacttcaccaatattcttctgctggataccgcctgcgatggcgataccgtcagcaacctggcgcgtaaaaaccagctcacgtttacggaggactgggagcatcgccactggtccggcgtcgaattactccgtgaactcaaacgccagcagcgctacccccacggcgccccggtggtatttaccagcaatctggggcgttccctctacagcagccgcgcagaatcgccgttgggcgagccggaatggggcatctcgcaaacgccgcaggtctggatagatcatctggcgttcgagcatcacggcgaggtctggctacaatgggacagcaacgacgcgctgttccctccggcgttagtcgaaacattgttcgacgcctactgccagttgattaacgaactctgcgatgacgaaagcgcctggcaaaagccgttcgcagatatgatgcccgccagccagcgcgcgatacgcgaacgggtcaacgccaccggcgcccccattcccgaaggcttgctgcatgaaggcattttccgtatcgctctgcaacagccgcaggcgctggcggtaacggacatgcgttatcagtggaattatcatgagctgacagactatgcccgccgttgcgcgggcaggttaatcgagtgcggggttcagcccggcgataatgtggctatcacgatgtcgaaaggcgcaggacaacttgttgcggttctggccgtcctgctggccggggcggtttacgttccggtttcgctggatcagcctgccgcacggcgcgagaaaatctacgctgacgccagcgtccggctggtgctcatttgtcagcacgacgccagcgccgggtcagacgatattcccgtccttgcctggcagcaggccattgaggcggagccgatcgccaacccggtagtacgcgcccccacgcaaccggcctacattatctacacctccggctctaccggtacgccgaaaggggtagtcatttctcaccggggagcgcttaacacctgttgcgatatcaatacccgctatcaggttggcccgcatgacagggtgctggccctctccgccctacattttgatttatcggtttacgacatttttggcgtactgcgcgcgggcggcgcgctggtgatggtgatggaaaatcaacggcgcgatcctcacgcatggtgtgagctgatccagcgccatcaggtcacgctctggaacagcgtcccggcgctgttcgatatgctgctgacctggtgtgaaggtttcgccgacgccacgccggaaaacctgcgcgcagtgatgctttccggcgactggatcgggcttgacctccccgcccgttatcgggccttccggccacaaggacaatttatcgcgatgggcggcgccaccgaggcgtctatctggtctaacgcctgcgaaattcacgacgtccccgcccactggcgctccatcccttacggttttccgctaaccaaccaacgctaccgggtggtggatgaacagggccgggactgccctgactgggtgccgggtgaattatggattggcggcattggggtcgcggaaggctatttcaacgatcccctgcgtagcgagcagcaatttttgacgctcccggacgagcgctggtatcgcaccggcgatctcggctgctactggccagatggcacaatcgagttcctcggtcgtcgcgacaagcaggtcaaagtcggaggatatcgcatcgagctgggcgaaatcgaaagcgcgctcagccagctggcgggggtgaaacaagcaaccgttctggcgatcggcgaaaaagaaaaaacgctggcggcatacgttgttcctcaaggcgaggctttttgcattaccgatcatcggaacccggcactgccgcaggcgtggcacacgcttgcgggaacgttgccctgttgcgccatctcgccagagatctccgcagaacaggtagccgatttccttcagcatcgcctgctaaaactgaagccgggtcacaccgctggcgccgatcctctccccctgatgaactcactcgctatccagccgcgctggcaggccgtggtggaacgctggttagcatttctggtgacacaacggcgactgaagcccgctgctgaaggttatcaggtctgcgctggtgaagaacgcgaggatgagcacccgcacttcagcggacatgatttaacgttatcgcaaattcttcgcggtgcccgtaacgaactgtcgttactgaacgacgcgcagtggtcgccggaaagcctggcctttaaccatccggccagcgccccgtatattcaggaactggcgacaatttgccaacagcttgcacagcgcttacagcgcccgatacgcctgcttgaggtgggaacccgcactggccgcgccgcagaatcgctgttagcacagctcaacgccggacagattgagtatgtcgggcttgagcagagccaggagatgctgctgagcgcccggcagaggctcgccccctggcctggcgcccgtctgtccctctggaatgcagacacgcttgcgacgcacgctcactcggcggacattatctggcttaataacgccctgcatcgtctgctgccggaagatcccgggctccttgcgacattacaacagcttgccgttcccggcgcgctgctctacgtgatggagtttcgccagttaacgccgtccgccctgctcagcacgctcctgttaaccaatgggcagccggaggccttgctgcataacagcgccgactgggcggcattatttagcgcggccgccttcaactgtcagcatggcgatgaggtcgcggggttacaacgcttcctcgtacaatgtcctgacaggcaggtgcgccgcgatccccgtcaacttcaggccgccctcgctggacgtctgccggggtggatggtgccgcaacggatcgtcttcctcgacgccttaccgctgacggctaacgggaaaattgactaccaggcgctgaagcgtcgtcatacccctgaagcggaaaacccggccgaagcggatttaccccagggcgacattgaaaaacaggttgccgccctctggcagcaactcttatcaactggcaatgtcaccagagaaaccgacttcttccagcaaggcggcgatagcctgctggcgacccgtctgaccgggcaacttcatcaggcaggttatgaagcgcaattaagcgacctgtttaatcatccccggctggcggattttgccgccacactgcggaaaaccgacgtcccggtcgaacaaccattcgtccactcccctgaagatcgctaccagccctttgcgcttaccgacgtgcagcaggcttacctggtggggcgtcagccgggctttgccctgggcggcgtcagctcacatttctttgttgaatttgaaattgccgatctggacctcacccggctggagacggtctggaaccgattaatcgcccgccacgatatgctgcgcgccatcgtgcgtgatggacagcaacaggtgctcgaacagacgcccccctgggtgatacccgcacacaccctccatacgcctgaagaggcgttgcgggtgcgcgaaaaactggcgcatcaggtactcaaccccgaagtgtggccggtattcgatctccaggtcggatacgtggacgggatgcctgcccgcctgtggctgtgtctggataacctgttgcttgacggtctcagcatgcagatcctgctggcggagctggagcacggctaccgctacccgcaacagctgcttccgccgctgcccgtcaccttcagggattatctgcaacaaccctcgctacagtcgcccaatccagattctctggcatggtggcaggcgcagcttgatgatattcctccggcgcctgcgttgccgctgcgctgcttgcctcaggaggttgaaacaccgcgcttcgcccgcctgaacggcgcgctggacagcacgcgctggcatcggctgaaaaaacgggcggctgacgcccatctcaccccgtcggccgtactgttgtcggtgtggtcaacggttctctctgcatggagtgcacagcctgagttcacgcttaaccttacgcttttcgacaggcgaccgctgcacccgcaaatcaaccagattctgggcgatttcacctcgctgatgctgctgagctggcatcccggcgaaagctggctgcacagcgcgcagtcactacagcagcggctgagccagaacctcaaccaccgcgatgtgtcagccatccgcgtgatgcgtcaactggcgcaacagcaaaacgtgcctgccgttccgatgcccgtcgtctttaccagcgcgctgggctttgagcaggataacttcctcgcccggcgtaatctgctcaaaccggtctggggcatctcccagacgccgcaggtctggttcgatcaccagatttatgaatccgaaggcgaactgcgctttaactgggattttgtcgccgcgctgtttcctgccgggcaggtggagcgccagtttgaacagtattgcgcattgctaaaccgaatggccgaggatgaaagcggctggcaactgccgctcgccgcgctggtgcctcccgttaaacacgcagggcaatgcgcagagcgctcaccgcgcgtatgccctgagcaatctcagccacacattgcggcggacgagagcaccgtcagcctgatttgcgacgccttccgcgaggtggttggcgagtctgtcacgcccgcagaaaacttctttgaggcgggcgcaacgtcgctgaatctggtgcaactgcacgttttgttacaacgtcacgaattttccaccctgacgttgcttgacctcttcacccacccttctcctgctgccctggccgattatctggccggcgtcaccacggtggagaaaacaaaacgacctcgccctgttcgccgtcgtcagcggcggatatagcgcgaagcaaactgattttccccggaacgccatcgcgaacgcatggcgttccattgactttgtgaatcttaggaaacgggaccgattatggataacttgcgcttctcttctgcgccgacagcagattccattgatgcatcgatcgctcaacactacccggactgcgaacctgtcgcggttatcggctacgcctgccattttcctgaatcgccggatggcgaaacgttctggcaaaatctgctggaaggtcgtgaatgcagccgacgctttacgcgcgaagagcttctggccgtcggtctggatgccgccatcattgacgatcctcattatgtcaatatcggtacggtgttagacaacgccgactgcttcgacgccaccctgtttggctattcgcgacaggaagcggagtcgatggacccgcagcagcgcctatttttgcaggcggtctggcatgcgctggaacatgccggttatgcccccggcgccgtcccccataagaccggcgttttcgcctcttcccggatgagtacctaccccggtcgcgaagcattgaacgtgacagaagtcgcgcaggtaaaaggtctgcaatctctgatgggcaatgataaagactatattgccacccgcgccgcgtacaaactcaacctgcacggcccggcgttatcggtacagaccgcctgctccagctcgctggttgccgtgcatctggcctgtgaaagcctgcgcgcaggcgaatccgatatggcggttgccggcggcgtggcgctctctttcccccagcaggcaggctaccgctaccagcccggaatgattttctctcctgatggtcactgtcgtccctttgacgcctcggctgagggcacctgggccggtaacggtctcggctgcgtggtgctgcgtcgcctgagagacgcgctgctgtcaggcgatccgattatctcggtgatcctctccagcgcggtcaacaacgacggcaacagaaaggtcggctataccgccccttccgtcgcagggcaacaggcagtcatcgaagaggcgttaatgctggcggccatcgacgacaggcaggtaggttacattgaaacccacggcaccggcacaccgctgggcgacgcgattgaaattgaagcgttacgcaacgtctatgcgcctcgcccgcaggatcagcgctgtgcgctcggttccgtgaaaagtaacatgggccatctggataccgcggcgggcattgccggactgctgaaaaccgttctggcagtcagtcgcgggcaaattcctcccttactgaattttcacacccccaacccggcgctgaaacttgaagagagcccctttaccataccggtgtcggcacaggcatggcaggacgaaatgcgctatgcgggcgtctcctcctttggtattggcggcaccaactgccatatgatcgtcgcctcgctgcccgacgcgctcaacgcgcgcctccccaatacggatagcggcagaaaaagtaccgcgctgctgctcagcgcagccagcgacagcgcgttgcggcggctggcgacggattatgccggggcgctgagagagaatgcggatgccagctctctggccttcacagccctgcacgcgcgccgtctcgatctccccttccgcctggcggcgccattaaaccgtgaaaccgccgaggcgctcagcgcctgggccggtgagaaatcgggggcgctggtttacagcggccacggcgccagcggcaagcaggtgtggctgtttaccggccagggctcgcactggcgcactatgggtcaaacgatgtaccagcactcaacggcgtttgccgacacgctggatcgctgtttttccgcctgtagcgaaatgctcacgccgtcactgcgcgaagcgatgtttaaccccgattcggcgcaactggacaatatggcctgggcgcagccggcgattgtcgcgtttgaaatcgcgatggcggcgcactggcgtgctgaaggactgaagccagacttcgccattgggcattccgtcggtgaatttgccgctgctgttgtctgcggacactatacgattgaacaggtcatgccactggtttgtcggcgcggcgcgctaatgcagcagtgcgcaagcggcgcgatggtggcggtatttgcagacgaagacacgctgatgccgctggctcgccagtttgagctggatctcgccgccaataacggtacgcaacatacggtattttccggaccggaagcccgtctcgcagtattttgcgccacgctctcgcagcatgacattaactatcgtcgcctgagcgtaaccggtgcggcgcactccgctttactggagccgatactcgatcggttccaggacgcctgcgcgggactgcacgcggagccggggcaaataccgattatttccacgctcaccgccgacgtcattgatgagtcaacgctcaaccaggcggattactggcgccgacacatgcgccagccggtgcgttttatccagagtattcaggtggcgcatcagctcggcgcccgcgtttttctggagatggggcccgatgcccagttggttgcttgcgggcagcgcgaataccgcgataacgcatactggatagccagcgcccggcgtaacaaagaggcgagcgatgtcctcaatcaggccctgctccagctttacgctgccggcgtcgccctaccgtgggccgacctgctggcgggcgatggacaacgtatcgctgcgccatgttatccgtttgatactgagcgttactggaaagagcgcgtctccccggcctgcgagcctgccgacgcagcgctgtctgccgggctggaggtggcgagtcgcgccgcgacagcgctcgatctccctcgcctggaagcgcttaaacagtgcgccacgcgactgcacgccatctacgtcgatcaactggtacaacgctgtaccggcgatgccattgagaacggcgtggacgccatgaccatcatgcgccgtggacgtctgctgccccgctaccagcagctactccagcgcctgctgaataactgcgtggtcgacggcgattaccgctgcaccgacgggcgatacgtccgcgcccgccccattgaacatcaacagcgggaatcactgctgacggaacttgccggttattgtgaaggttttcaggctattcccgacaccatcgcccgtgccggcgatcggttatatgaaatgatgagcggcgcggaagaaccggtggcgattatcttcccgcaaagcgcctccgacggcgtggaagtgctgtatcaggaattcagctttggccgctatttcaaccaaatcgccgccggggtattacgcggcattgtccagacgcgtcagccccgccagccgttgcgtattcttgaagttggcggcggaaccggcggcaccaccgcgtggctgctgccggaactcaacggcgttccggcactggagtaccatttcaccgatatctcggcgctgttcacccgtcgcgcccagcagaaattcgccgactatgattttgtgaagtatagcgagctggatctcgaaaaagaggcgcagtctcagggtttccaggcacagtcttacgatcttatcgtggcagcgaacgtgattcacgccacccgccatattggccgcacgctcgataatctgcgccccctgctcaagccgggcgggcgcctgctgatgcgcgaaatcacccagccaatgcgtctgtttgacttcgttttcggcccgctggttcttccgctacaggatctcgacgcccgcgaaggtgagttattcctcaccaccgctcagtggcaacaacagtgccgccacgccggattcagcaaagtggcgtggctaccgcaggatggcagcccgaccgccgggatgagcgaacatatcattctcgccacgctgcccggtcaggcggttagcgccgtaacattcaccgcgccatcagaacccgtgttggggcaggcgctgacggataacggtgattatctcgccgactggtctgattgcgcaggtcagcccgaacggtttaacgcccgctggcaggaggcctggcgtctgctttcacagcgtcatggcgacgctctgcctgtggaaccgccccccgtcgccgccccggagtggctggggaaggttcgcttaagctggcaaaacgaagccttttcccgcggtcagatgcgcgttgaagcccgtcatcctgctggcgagtggctgccgctatcgcccgccgcgcctcttcctgcgccgcagacgcattatcaatggcgctggacgcccctcaacgtcgccagcattgaccaaccgcttacctttagcttcagcgccggtacgcttgcgcgcagcgacgagctggcgcaatacggcatcattcacgatccgcacgcctcttcgcgactgatgattgttgaggagagcgaggatacgctggccttagcggagaaagtgatagcagcgctcaccgccagcgcagccggattgattgtggttactcgccgcgcgtggcgagtcgaggaaaatgaagcactctctgcatcccatcacgcgctatgggccttgcttcgagtcgcggccaacgaacagccggaacggttgcttgccgccatcgatctcgccgaaaacaccccgtgggaaacgctgcatcaagggttgagcgcagtctcactatcacagcgctggctcgccgcacggggtgacaccctttggctcccttcactggcgcccaatacgggatgcgccgctgaattaccggcaaacgtgtttaccggcgatagccgctggcatctggtgaccggagcgtttggcggattaggccgccttgccgtgaactggctcagagaaaaaggggcgcgacgcatcgccctgctggcgccgcgcgtggatgagtcatggctacgcgacgtggagggcgggcagacgcgcgtctgccgttgtgatgtgggcgatgccgggcaactggccacggttcttgacgatctggcggccaacggcggcattgccggagcgattcatgccgctggcgtattggctgacgcgcccttgcaggagcttgatgaccaccagctggctgccgttttcgcggtaaaagcgcaggcggcaagccagctgttgcaaaccctgcgcaaccacgacggacgctatcttattctctactcttccgctgccgccaccctcggcgcgccgggtcagagcgcccatgcgctggcctgcggctacctggacgggctggcccagcagttttccacccttgatgcgccgaaaacgctctctgtcgcctggggcgcatggggagaaagcggtcgggcggccacgccggaaatgctggcgacgctcgccagccgaggtatgggcgcgttaagcgatgccgaaggctgctggcacctggaacaggcggtgatgcgcggcgccccgtggcgactggcgatgcgcgtttttaccgacaaaatgcccccgttacaacaggctctgtttaacatcagcgccacagaaaaagccgcaacgccggtcattcctcctgctgatgacaacgcctttaacggcagcctgagcgatgaaacagcggtgatggcatggctgaaaaagcggattgcgattcagctaaggctgagcgatccggcgtcactgcatccaaaccaggatctgttgcaactcggcatggactcgctgctcttccttgaactcagtagcgatattcagcactacctgggcgtacgcatcaatgcggaacgggcgtggcaggatctgtctcctcatggactcacgcagcttatctgttctaagccagaggcgacgcctgccgcttcgcagccggaagtgttgcggcacgacgccgacgagcgttatgcgcccttccctttgacgcccattcagcacgcctactggctggggcgaacccacctcattggctatggcggcgtcgcctgtcacgtcctgtttgagtgggataaacgccacgatgagttcaatctcgccatactggagaaagcatggaaccagctcatcgcacgccacgatatgttgcgtatggtggttgatgccgacgggcagcagcgaatcctggcgacaacgccggagtatcacatcccgcgtgacgatctgcgcgcgctttccccggaagaacagcgcatcgcgctggaaaaacggcggcatgaactgagctatcgcgttttgcctgccgaccagtggcctctttttgagctggtggtcagcgaaatcgacgattgccattaccgtctgcatatgaacctcgaccttttgcagtttgatgtgcagagttttaaagtcatgatggacgacctggcgcaggtctggcgcggtgaaacgctggcgccgctcgctattaccttccgtgattatgtgatggctgaacaggcgcgccgacagacatcggcatggcacgatgcctgggattactggcaggaaaaactgccgcaactgcccttagcgccagagctgccggtggttgagacgcccccggaaacgccacacttcaccaccttcaaatcgacgatcggcaagacagaatggcaggccgtgaaacagcgctggcagcagcaaggcgtcacaccgtctgccgcgctgctcacgctgtttgccgccacccttgagcgctggagccgtaccacaacatttacgctgaacctgacgttcttcaatcgccagccgatccatccgcaaatcaaccagttgattggtgattttacctccgtcacgctggttgattttaacttctcagcgccggtgacgttgcaagagcagatgcaacagacccaacagcgcctctggcaaaacatggcgcacagtgaaatgaacggtgttgaggtgatccgtgagctgggccgcctgcgcggatcacaacgtcaaccgctgatgccggtagtgtttaccagtatgctggggatgacgctggaaggcatgactatcgatcaggcgatgagccatctgttcggcgaaccctgctatgtattcacgcaaacgccgcaggtctggctggatcatcaggtcatggagagcgacggcgagttgatgtttagctggtactgcatggacaacgtgctggaacccggcgctgccgaggcgatgtttaatgactattgcgccatcctgcaagccgtcatcgccgcccctgaaagcctgaagactctcgccagcggcatcgccgggcacattccccgccgacgctggccgctgaacgcgcaggcggactacgacctgcgggatattgagcaggcgacgctcgaataccccggcatccggcaggccagagcggaaataaccgaacagggcgcgttgacgctggatatcgtgatggccgacgatccgtcgccatcagcggcgatgcctgatgagcacgaacttacccaactggcgctgccgttgcctgagcaggcgcagcttgatgagctggaggcgacctggcgctggctggaggcgcgtgcgctacaggggatcgcggctacgctaaatcgtcacggcctgtttaccacgccggagatcgcccatcgctttagcgcaatagtacaggcgctgtccgcgcaagcgtctcaccagcgtctgctgcgccagtggctacagtgtctgacggaaagagagtggttaatccgcgaaggtgaaagctggcgctgccgcattccgctcagcgagattcctgagcctcaggaagcgtgcccgcaaagccaatggagccaggcgctggcgcagtatctggaaacctgcatcgcccggcacgacgccctcttctccgggcggtgttctccgctggaattgctgttcaacgagcagcatcgcgttaccgacgcgctgtatcgcgacaaccccgccagcgcctgtctgaatcgctataccgcgcagattgccgccttgtgcagcgcagaacggattctggagattggcgccggaaccgcagccactaccgcgccggtgctgaaggccacgcggaacacgcggcagtcgtaccacttcacggacgtctccgcgcagttcctcaatgacgccagagcccgtttccatgatgaatcgcaggtgtcttatgccttgttcgacatcaaccagccgctggatttcaccgcccacccggaggcgggttacgacctgatcgttgccgtcaatgtgctccacgacgccagccatgtcgtccagacgttgcgcagattaaaactgttgctgaaagccggcggacgtttgctgatcgttgaagcgacggagcgaaacagcgtattccagctggcgagcgtgggctttattgagggattaagcggataccgcgatttccgccgccgggatgagaaaccgatgctcacccgctccgcatggcaggaggttctcgttcaggccgggtttgcaaacgagctggcgtggcccgcgcaggaatcgtcgccgctgcgccagcatctgctggtggcgcgttcgcctggcgtaaatcgcccggataaaaaagccgtgagccgctatttacagcagcgctttggcaccggtctgcccattttacagatccggcaaagagaagcgttatttacgccgctgcatgccccgtctgatacgccgactgagccagccaaacccacgccagttgccggggggaatccggcgctggaaagacaggtggctgaactctggcaatcgctgctgtctcgccccgtggcaaggcatcacgactttttcgaactgggtggcgacagcctgatggcgacaaggatggtcgcgcagctaaaccggagagggattgctagggctaaccttcaggatctgttcagccattcgacgctgagcgacttctgcgcccatctacaggcggctacgtcaggagaggacaacccgatacccctttgccagggcgacggtgaggaaaccctgtttgtcttccacgcttcagacggcgatatcagcgcctggctgccgctcgctagcgcgttgaacaggcgcgttttcggcctgaaagcaaaatcgccgcagcgctttgccacgctcgaccagatgatcgatgagtatgtcgggtgcatccgtcgtcagcagcctcacggcccttatgtgctggcgggttggtcgtatggcgcgtttcttgcggcgggcgccgcacagcgcctgtacgccaaaggcgagcaggttcggatggtgttaatcgatcccgtgtgccgacaggatttctgttgcgaaaaccgggcggccctgctgcgcctgttagccgaaggacaaacgcctctggcactgcccgaacatttcgaccagcagacgcccgacagccagcttgccgactttatcagcctcgctaaaacggccggtatggtgtcgcaaaacctgacgctgcaagcggcagaaacgtggctcgacaacatcgcgcatctgctgcgtttactgactgagcatacgccgggcgaaagcgttccggtcccctgtctcatggtgtatgccgccgggagacccgcgcgctggacgccagcagaaaccgagtggcagggctggataaacaacgccgacgacgctgtgattgaagccagccactggcaaatcatgatggaagccccccacgttcaggcttgtgcgcaacacattacgcgctggctttgcgcaacctcaacgcaaccggagaacacgttatgatgccgtccgcctccccaaaacaacgcgtactgattgtgggcgccaaatttggcgaaatgtacctgaatgcctttatgcagcccccggaggggctggaactggtcggcctgctggcgcagggaagcgcccgttcaagagagctggctcatgcgtttggcattccgctgtatacctcgccggaacagataaccaggatgccggatatcgcctgtattgtcgtgcgttcgaccgtcgccggaggaaccggtacgcagcttgccagacactttctgacgcgcggcgtacacgtcattcaggagcatcccctccacccggatgacatcagttccttacaaacgctggcgcaggaacagggctgctgctattgggtaaacacgttttatccgcatacgcgcgcgggacgcacatggcttcgcgatgctcagcagctgcgtcgctgcctggctaagacgccgccggtagtccacgccaccaccagccgacagttgctcaactccactctggatttgttgttgctggctctgggcgttgatgccgccgccgtggagtgcgacgtggttggcagctttagcgattttcactgtctgagactcttctggccggagggagaagcctgcctgctgcttcagcgctatctcgatcctgacgatccagatatgcatagccttatcatgcaccgcctgctgctgggctggccggaaggtcatctttcgctggaggcgagttacggccccgtcatctggtcatccagcctgtttgtcgcagaccatcaggagaacgcccacagcctctaccgcagaccggagatcctgcgcgatctgctgggtctgacgcgcagcgcggcgcccctgagctggcgcgactgctgcgaaaccgtcgggccggagggcgtcagctggttgctacaccagttgcgcagccatctggcgggcgaacatccaccagcggcctgccaaagcgtacatcagatcgcgttatcacgtttatggcagcagattttacgtaagaccggcaatgcggagatcagacgcctgacaccgccgcaccacgaccggttagccggtttctacaacgatgatgataaggaggcgctgtgacgcaatctgcaatgtgcatcccgctgtggcccgcccggaacggcaatactgcgcatctggtcatgtgccctttcgctggcggcagcagtagcgcgtttcgccactggcaagctgagcaactggctgattgcgcgctttctctggtgacctggccggggcgcgatcgccttcgccatctggaaccgctcagaagcattacacaactggcggcactgctggcgaacgagctggaagcatccgtatcgcctgacacgccgcttttactcgccgggcacagcatgggggcgcaggtggcgtttgaaacctgccgacttctggagcaacgggggcttgcgccacaaggactgattatttccgggtgccatgccccgcatctgcattctgaacgccagctcagccatcgcgatgatgccgactttatcgctgagctgatagacattggcggatgttctcctgaactgcaggaaaaccaggaattaatgtcgctgtttcttcctcttctgcgcgctgatttttacgccaccgagagctatcactacgactcgcccgacgtctgtccgccgctgcgcacgcctgcgctgttattgtgcggcagccacgatcgcgaagcctcctggcagcaggtcgatgcctggcgtcagtggctgagccacgttacaggcccggtggtgattgacggcaatcatttctatcccattcaacaagcccggtccttttttacgcagattgtccgccattttccccacgcattttctgcaatgaccgcgttgcaaaaacagcccagtacttcagaaaggtgacgcatgaattcttcctttaaatctctgattgaacagtatcccttacccattgccgaacagttgcgccactgggcggcccgttatgcctcgcgaattgccgtcgttgatgcaaaggggtcgttaacctacagcgcgcttgatgcacaagttgacgaacttgccgcaggtctgtcatcactgggtttgcgttcgggggagcatgtaattgtgcagcttcccaacgacaacgcgtttgttaccctgctgttctccttgttaagactgggcgttatccccgtgctggcgatgccctcgcaacgggcgctggatatcgacgcgctgattgagctggcgcaacccgtcgcttacgttattcacggggaaaaccacgcagagctggcccgacagatggcgcacaaacacgcctgcttgcgtcatgttctggtcgctggagagaccgtgagcgacgattttacgccgctcttctcccttcacggtgagcgacaggcatggccgcagcctgatgtttccgccaccgcgttgttgttgctctcaggcggcacaaccggcacgcccaaactcatcccgcgccgacatgccgactatagctataacttcagcgcttctgctgaactgtgcggcatcagccaacagagcgtgtatctcgccgtcctcccggtggcgcataactttccgctggcctgccccggtattctgggaacgcttgcctgcggcggaaaagtggtgctgaccgacagcgccagctgtgatgaggtgatgcctttaatcgcgcaggaaagagtgactcacgtcgccctggttccggcgctggcgcaattatgggtgcaggccagggagtgggaagacagcgacctttcgtcgctgcgcgtcattcaggcaggcggcgcccggctcgacccgacgcttgctgagcaggttatcgccacctttgactgtaccctgcaacaggttttcggtatggcggaaggcctgctctgttttacccggctggacgatccgcatgccaccattctccacagccaggggcgcccgttgtcccctctggatgaaatccgcatcgttgatcaagacgagaacgacgtcgcgccgggcgaaaccgggcaattgttaacgcgcggcccttataccatttcgggctattaccgcgcccctgcccacaacgcgcaggcctttaccgcgcaagggttttaccgcacaggcgacaatgtcaggctggatgaggtagggaacctgcacgttgagggacgcataaaagagcagatcaaccgcgccggagaaaaaatagccgcggctgaagtggaatcggcactgctgcgtttagcggaagtgcaagattgcgcggtggtcgccgcgccggacacgctgcttggcgagcggatttgcgcgtttatcatcgcgcagcaggtgccaactgactatcagcagttgcgtcaacaactgacccgtatggggctcagcgcgtggaaaattcctgaccaaatcgagtttctggaccactggccgctcaccgccgtcggcaagatagacaaaaaacgcctgacggctctcgccgtcgaccattatcgccattctgcccaataagcgcaaaccgacccgaaacaggttgaaataaacccgtttcgggtagcaccactattagaaatagttatcattttcaattcaccattgtcggtatttttggcgtttcgccgtcttacagggactcacaacaatgaaaatgacacggctttatcctctggccttggggggattattgctccccgccattgctaatgcccagacttcacagcaagacgaaagcacgctggtggttaccgccagtaaacaatcttcccgctcggcatcagccaacaacgtctcgtctactgttgtcagcgcgccggaattaagcgacgccggcgtcaccgccagcgacaaactccccagagtcttgcccgggctcaatattgaaaatagcggcaacatgcttttttcgacgatctcgctacgcggcgtctcttcagcgcaggacttctataaccccgccgtcaccctgtatgtcgatggcgtccctcagctttccaccaacaccatccaggcgcttaccgatgtgcaaagcgtggagttgctgcgaggcccacagggaacgttatatggcaaaagcgctcagggcgggatcatcaacatcgtcacccagcagccggacagcacgccgcgcggctatattgaaggcggcgtcagtagccgcgacagttatcgaagtaagttcaacctgagcggccccattcaggatggcctgctgtacggcagcgtcaccctgttacgccaggttgatgacggcgacatgattaaccccgcgacgggaagcgatgacttaggcggcacccgcgccagcatagggaatgtgaaactgcgtctggcgccggacgatcagccctgggaaatgggctttgccgcctcacgcgaatgtacccgcgccacccaggacgcctatgtgggatggaatgatattaagggccgtaagctgtcgatcagcgatggttcaccagacccgtacatgcggcgctgcactgacagccagaccctgagtgggaaatacaccaccgatgactgggttttcaacctgatcagcgcctggcagcagcagcattattcgcgcaccttcccttccggttcgttaatcgtcaatatacctcagcgctggaatcaggatgtgcaggagctgcgcgccgcaaccctgggcgatgcgcgtaccgttgatatggtgtttgggctgtaccggcagaacacccgcgagaagttaaattcagcctacgacatgccgacaatgccttatttaagcagtaccggctataccaccgctgaaacgctggccgcatacagtgacctgacctggcatttaaccgatcgttttgatatcggcggcggcgtgcgcttctcgcatgataaatccagtacacaatatcacggcagcatgctcggcaacccgtttggcgaccagggtaagagcaatgacgatcaggtgctcgggcagctatccgcaggctatatgctgaccgatgactggagagtgtatacccgtgtagcccagggatataaaccttccgggtacaacatcgtgcctactgcgggtcttgatgccaaaccgttcgtcgccgagaaatccatcaactatgaacttggcacccgctacgaaaccgctgacgtcacgctgcaagccgcgacgttttatacccacaccaaagacatgcagctttactctggcccggtcgggatgcagacattaagcaatgcgggtaaagccgacgccaccggcgttgagcttgaagcgaagtggcggtttgcgccaggctggtcatgggatatcaatggcaacgtgatccgttccgaattcaccaatgacagtgagttgtatcacggtaaccgggtgccgttcgtaccacgttatggcgcgggaagcagcgtgaacggcgtgattgatacgcgctatggcgcactgatgccccgactggcggttaatctggtcgggccgcattatttcgatggcgacaaccagttgcggcaaggcacctatgccaccctggacagcagcctgggctggcaggcgactgaacggatgaacatttccgtctatgtcgataacctgttcgaccgtcgttaccgtacctatggctacatgaacggcagcagcgccgtcgcgcaggtcaatatgggtcgcaccgtcggtatcaatacgcgaattgatttcttctgattattgtaaaagggataccgaaaaggtatcccttttacaccactagttaaaaccagtaactcagcagagtcgcaaaaaatattaatccatagtgattatttaaacaatgaaattgcgattaggacaaatagatttaactttctcgttcctttctctccttatactaaagaaataatcatatcaaaataaaaattcacaacagtgcaacattaaaaacacaaccaacaaacaatcctatatacaaggcacatctccagaatataaaagcacagacaaacaacctaaaaaaacaacccgaattaataaaacctttacaattacacaccctcaactcaaaacaatttcgaaaactcaaagatttcatcggcaaaaacagtcattaacacatatattttttgaaattctgtagagtaaaactgatataaagcatttatcatattaacatatcaataagtgcaaacttaaaaatcaaaagttagggttcagtaaaaccaattcgccacaaaaaaaaccaccccatacatataaattattttataggtaaaatagattatatattctcatagctaccacaaactatactagcctgaactatatttattcttctgcaatcaatgcatacataacacaaatatcactcaggtacactactcaaaccacgctgggatttttcctcaagttataatcatcaccccgaaaatcattcggcatttactcattaaatagtcaccccataggcctgtacatgtttactcagaaatatacatccttttctctgtcacaaaccctctgattaatcataaataaatacttgtgacaccaatctttttccttaacggaacgaattgttgtgtagaaggagataatattatgtcaaaaaaatatcagccattgcttataactcattatatgtcaacatgggtcactataacggaagcagttgagatcactaccaaagccataaaacaaaaaattactcctagcgatatttatcgtcatgccttgagtggcaacatcctactatcggtctatttccagtctcctgtgatacttaagaagatacaaacttttaatggaaaaataaaattcaggcagtttgagggagacctacttgataaactatgcatgcttgacagggacggttttatttatggtcaaaatttaagactctgtacagaagccagatatgtttgtcctgtgcaacaaattatagatacccccctgataggctatgaatatgttttgattcagcgcatactggcacgtgaacttaaattcccctccccaattgtgggggcaagaaaaactaaccatggtattatagtaagattttcagaggagctttttcaaattttcgaaacgatgagttggaaagaacgcgtagaaaaacaaatttccagactacctaaaaacacagcattagatgtcataaaaaaactaacagaagtgacgaccataaaatataatcacaatgggtgttttcctctttatacattaccgcctgatgcctgttttgttattcgccacaccgaagtcgaaagactaattaatttatacaaaaaaagggagagtcatcccatttcaccttcccgtatgacaacaccgttatcacgcctgttttggctggcctgcaagcacaatgatattatcagcccactgctgaatcatccctataagctcctttctatttttgaacaatgggcatcaggcgatggcatcggggaaaaactggacgctgaaacactgaaaaatgcgctgaagcgtggttcgccatcttcgacatccttatccggctaataccatccccatttgtaatggccgacaaccctaaataagggttttgcatcccttatttagggctcaccagctttctctcaggcttccactgtgtttttttattctccggccaccgtttatttcagtcacaggaggatatatgacatcttatcagttactacgcctcagacaggttgagcaaaaaacagggctgaagcgttcacagatatacctttatatgaaagagggtgcatttccccgttcaataaaaataggccctgctagtgttgcctggctcgagtctgagattgacgagtggatcaacaaaaagttatctgaccgataaagacgcaatgaggagaagatgatgaacattaatatcccggcactcataaacttcgatcctgcaggtataaaaaaaagcacctgcatgtatatttcagacctgcccggtattgtgctatatgacactataccattcactgaatattcagctgaattactgagtacttattcagttaaggagtcaatttcatgcttccatccctgaatcatattatattaaccgttgctcttcaggcgctacgggaaggaaatattcatcactgcgaaactatgggattcacttacgatgaaatgaatttgctcggttgcttatcaataaacgatcttatcaccctcagtcaggcacctttaccgcttgtcgatattactatccgccatgatgtcctgcaaaaattactggcatcatcccacgaggaaaacaggcgtcaggaacaactgaacagagctgtcaggctggggggctcaatcgcactgatgaaccgttatttcggggttggctccagagaaacctgtgcacgccgccggttactcggtgtctccgttccaaacgggagaacacccattccggatgaagaaaccgatgctgcaatctggcatcagtggcaaaaatatcgggtcgaaaacattgattccccggaggcgctggacgccatgatgctggttacagaaaacctttcatcgtgtactgccccctcgctgaccgttgtctggaactgcatcacgcattgcgaaagaaagaacacggtaaggagaatacaacgtgccagatgaaatcgatcgcgatcaggcgtttaatgaacggtgcctagaagcactgattgaacaaagccggttaagacccacaccgacaccttccctgcagcactgtcgattatgcggcaaggctattccggaaaaacgccgtcagacgctgccgggtgtaacaacctgtactgactgtcagtcgatactggagaaacgcagacgttaaatctgtatgtgcggaggagaatagctccgcacattttaatatgcaccagccggcttgttttcaggttcccgtgcctccatgtcatggatgaataacctgctcacatctcctgctgtggcaatccttttttacagtcagtacaccagaggtcagacatgaacaaaccggcaaacaagatggaattcgtcagaaaactgcggtaaataaatgacggcagcctgctggaaaaggttgtcgggcatatggaagaaaagctcacagggaatgagcttgaaatgctttatgccgcagcagattatcgccgcgcagagattgtaatgaaccagtactttgataaggttcccggtaatgcctggaaatatgtcagataactctgtgttttttatgcaacaggtacagacggataccactgcggcatgaaaacgaatttcaccacccggcccggtaagtatcggcctaagtggccaggaaacgtttaaccagattaaagaccgtcccttacaacaaaagggactactgtattcctgtctttcacgccttacacattattgtcgttaccaaattcagccacagagacagcatacaaccccatctgaaatataaagaaagtcttcctccggatgtttaatttaacctgataataatcaacaaatattattatcagcccgcccgtcatcattcatgcacacacacaccgtgccagtaatacgttaatttcacatacttttttatcattccttccggtatttattttcccgttaaaatttcattacccctcctgcatcctgaccatgctctttaacaatatggagcgggctgtcacacaaccataattcagggtgccgctgaatgttctcgctgacccgttaaaaccggaatgcaggatcggaatgtgatcgaagaaatcatcttcaacaattttaattaaacgaggacactatgagaaagcctgtttattacgcgtatgttgcccaggaaagtcatccggactctcagggtgagaaaaatacctggtggacaaaggtcggagtcgcctttccccaccacggtaaatccggtctgaatattgtcctgacgcccggtattgccgtttccggcaaactggtcctgcttgagccccgggaggaaaataatccaccacagaatacgggccccatcgaaaccgtgtcgtaaccacccttaattctgttcccacggcatgcagtatcagcagaccctgcatgtcacttgtttactgaggtcaccatgctttccaccacagcctttctggcgatagccatgcagtgcgccgccagcattcatccgtccacggcattcgacgtggcacgggtggaatccggttttaacccttatgccatcgctgagattgtcccgaaggccggcccctctttcggcgatcaacacattatttctcacctgccagccagccggggagatgcagagcatattctccgtcgcctgtcagcacaggatcgccgttactctgtcgggctgatgcaaatcaccagcaccaatttccgccattatggtgtgtccgccacagagctacttgatccctgtaccaatctgtccgtcttcgaacacattctcagagactgctaccggcgcggcggcacgctgaaaagggcgctgagttgttattattccggcaatttcagtaccgggcaacaacctgaaacggcgttttccggaacgagctatatccagcgaatcggttatccgccgggatcatcccgctatgcggtccccggaacccgtgaggacaaatcatcagttgccgttcccctgaaaaccgcccctgccagtgactcatcccgtcaccacgtgttctggcccggagtcgtcgtccgtggcgtccctgcgaaactccgccaagaaaaaatcttcatcgcacctttctccgcgccgtcagtgcgccggagtttctccctgtcaccccgtgaggaggaggaataatgatacttttccgcaagctaaaagctgtggtcccccccgtttcggcctgtacgctgacgactttttctgcaaccccggcactggccgacggatttcagcgggcaaatactgtcatgcaaaaagtgtcaaccgggctgcatggtctggcggcaatcacgatcaccgtggccgtgatctggattggctataagaccctgtggaaaggcgagagcctgtcgcagtgcggctacatcatcattggcggcattttaattggcggaggcagtgaaatcggcgctctgctgatgagctaagaggctgaacatatggcaaagctgctcaaggcaatgaaacgcccggcggcgctgtggggggtgccaatggtgcccctgctggctgtcacgggtgtaaccatcatcgttgctatctggacttccgtcgctctcctgttcttacttcctgtgcaatttctggtgatgaagtcccttaccagaaatgaaccgatgcggttcaatctgattgccgtatggctgagagcgaagggaaagccggtagcaaaccgtttatttggcgcaacaacatttatgcccgttgagcatgatgatgttgatatcaaggagtttctcgacgccatgaaactaaatcagtgtgccaccatcaagaagtacatcccgtactcatcgcacattcatcagcatgtggttcgttcccctaagagcgatctgtactgcacctgggaattgatgggaacgccgttcgactgcgagtctgacgagtcgctccagttcgggacgaaccagttacacgggctaatccgctcattcgaaggtatgccagttactttctatatccataacgaccgcaatacgtttaccgacaatcttcataaagattccggcaacccgtatgccgatgaagttagccgtctttactacgcttctgtcggtctgttccggcgcaaccgcctgttcctgacggtctgctatcgcccgtttgtcagccttgaaaaagcagaacgcaaacggatgaaagacagccagaaactaaaggagctggacggtgctttgctggaaatgctggaaataaaaagcacgctcgataccgcgctgtcgcgctatggtgcgcgacctctcggtacgtttaccgaaggaaacgcggtgttttcgtcgcaactggctttctatgaatatctgctaacgcaccagtggcgaaaagtgcgcgtcacccgtaccccggcctatgacgtgatgggggcggcggcgttgttcttttcggctgaatccgggcagataaaccacgccaacggtacgcaatatttccgggggctggaggttaaagagttcgccgaagagaccgccacggggatgatggactcccttctttacgccccctgcgattacgtgatcacgcagtcctatacatgcatgtcacgcgaggaagcgaagaaagccattaagcgtacccgccgccttttgatgagtgccgacgacgatgctgtttcccagcggctggatctggatgtggcgcttgacctgctgacatcggggaaaatcgcttacggcaagcaccatttttccatcatggtgtattccccgtcgctggaaagcctggttgctgatacgaatgaaatcagtaacgcgctgaacaacatagggataacgcctgttccggcagaaatatcgctttcagcggcgtatatggcgcaactgccaggcaactacaacctgaggccacgtaaaggggagctgagtagccagaactttgtggagctggccgcgctccataatttctatccgggcaagcgcgataaagccccctggggggatgcgatggctttactgcgcaccccgtcaggcgatggctactatatcaacctgcataacacactggcagataaggacgaattcaacgagaagaacccggccagtacctgcatcctcggtacgaacggttcgggtaaaaccatgttgatgacgttctttgagatcatgcagcagaaatacgggcgcgaggatagcttctccccggatgccaaaaccaaacggctgacaaccgtttacctcgataaagaccggggcgcagagatgaacatccgggcgctgggtggccgttactatcgggttatcagtggtgagtctacagggtggaacccgttctcgttgccagcaaccaaacgcaatatcaatttcatcaagcaactgatgaaaatcctttgtacccgtaacggctcgacgatctccccacgcgatgaacgccgtctgagtgatgcggtcaatgctgtgatgaatgacgagccgcaatatcgcgtctacggcattacccgaatgctggaaaatttgcctgagccggctacgaaagaagcccaggaaaacggccttagcattcggttgtcacagtgggcgcagggcggtgagttcggctgggtgtttgataacgagtctgacacgttcgatatcagcaactgcgataacttcggcatcgacggaacggagttcctggacgatgcaagcgtatgtgcgccaatctcgttttatctgctgtaccgcattaccagcctgcttgacgggcgacgcctggtcattttcatggatgaattctggaagtggttacgcgacccggtgtttaaggactttgcttataacaagctgaaaaccatccgtaagctgaacgggatgctggtcgtcggtactcaatccccggcagagatcatcaaagatgatatcgccccggcagtgattgagcagtgcgggacacagattctggcggcgaaccccaacgccgaccgcgcacactatgttgacggtatgaagtttgaaccggaagtgttcgacgtggtgaaagggcttgacccgcaagcccgccagtatgttgtggtgaaaaatcagttcaagcgcggcgataccaaacgttttgccgctcgtgtcacgctcgacctgtcgggtatcggcagatacaccaaagtcatgagcggcgatgcccccaacctcgaaatattcgaatcgatttaccgggaaggaatgcagcctcatgaatggctcgatacctacctggctaaagcgctctgacccaaaggagatatacgatgaaaactcgctttcgtactcttattctggcttgcgtcattgcaagcccactggctcatgctggtattcccgtcgctgttgatgctgaccctatgcgggacgtgcagtgggcgcaggagttaaaacgctggatggaaacggccagacactaccagtcacaaatacaggcatataaagaccaactggcgacggccactggcgttcgtgatattgctgattttgttgaccaggccaaaggcctgaaagctgaccttgaaaagctgcgtaagcccggacaggcactgaatgacctgcttctctccggcggttcctccgggcagttcgatgcgttgtacgagaagtataaaattttcgacacctgcaacactgcgcaatcggggagttatgccaacgtatgcaagcagcaggtcatcaacaaggctatccagcttgagcaaaccgacgaggttcagaaccaggtaagccagaccctgggggaaataaacagtctctccaacagggtagcgttagccaaagattcgaaagaatctcaagaccttgcaaacagtattcagctaaaatctgtcatgctgaacacgcttaccacccaatgggaaatgagcgtgaaagcagcagagaagcgcgaaaatgcgctagaagcggagcgtgttaagcagtggaatcagcagcagttaaacgcgccaactgctgaccttaataatttatgaggtatttatgttatcaaaaaaaattattttaatttcgacgatcaccctgtgcttttctattgttggatgcaaagaggaagctaaaacaacaaaatggtatagggatcaccctgacgaattaaaactagcttatgaaaagtgccaaaagagtggtgacgcttctgataattgcaagaatgcaaatgaagcccactatcaaatcaagcagctaaacgcaccaactccagacttaaataatttagaggagtaatatatgagtggcggtctttttgttggggttgagaaatacctgataggaggaattacagacgccacaaagagattgatgatgtcgtactcttctatgatgatggggttggcagcagcgtcagctaccatctacatcatgtggcgtggataccagactttggctggtaagctatctacgcctatggaagacacgatgtgggacatcatgaggatggcgatcatcctgtccttcgtggctaatttaggcggctacctcgatggcgttattgatgccataaacggaataaaggagggtttttctggtagtgataatatatggcagttattagacaccctatggaataaggctaaagtgttagggaaaacgctacatgacatggataattctacatatgtaaaagatgagggaatgactgctcaattttgtgtatggcttggaatattcgcacttatgattctagcgggctttgtttcaatggttgccgaagtaatgattctactattaggaataactgcacctattttcatattctgccttatgtatggtttcctccgccccatgttcaataactggttgcaaaatatatttgcaggaatattaacaattctatttaccgctctctcattgagaattgtagtgaattacttgaatctcgttcttaataaggcgacgaaggtagcagacagttcaacaattgttgaacttggtgctcaagtctgccttgcaggtattttcgctgcaatactggtgtatatttccgctaaggtagccgcagctctggccggggcaagcgctaccgtatccatgcaggggctggccgctgtaggtatcggtgcggctgcttttggtgccgggaagctagccgggggtgcagttaaagaaaccaaacgttccgcccaggacaacattcagggctggaaggatgcgaatgcaggtaagcccggcaagcccggaggtgagttaggctataacgcatctaaagcgcggaagtacgcgattgagcagatgatagcccggaacgaagcgcggaggctggcacagtcgagagaatccgcggttaagaagttcaacagctaggccagacgtctcccgtccattcccccgaaatatcatcatatgaaaatataattatattttcatatatctaatttagttgaggaaatcattgatgaaacgcttgattgcgctggctttgctgtgcgcgctttctggctgcgcccagaacacgcctccctctgcctttagcggtaagggagaacccgtaaacacccctcaaattatggcggagttaaacagtcatgagtgaacagaaattaatagctgaatcccgcacttttgagcagcaaatgattgagcgggataaacgcgccacaaaagccggttttgttgttggcggtatgggtctgctgattgcggtactggcgctcgtcgccgtggtcgtgatgttgccgctgaaacagacggacgttgagctgtataccttggataaccacacaggacgggtggaacacgttacccggacatcgaaaaccagcctgaccgcaacagaagcctatcaaaaggcgatggccgcaaactacgtcaaagtgcgtgagcggtatgtctatccctctttgcaggacgactacgagacggtacaggtctacaacgctccccaggtaaacgatgactatctggcgctttacgccggaaaaaacgccccagacaaggtttataagaacggggcgcacaccgtgaaagtggagatcttgtccaaccagatcaccgatgcgacagcccctgatagggtcgccaccatccgctacaagaagattatccgccgtctggctgataacagcacccgcaacgaatattgggatgcccggttcacgttccattctaaccctgacaaggaaatgagcgatgcggaacgcgagatcaactacttcggctttaccgtcaccagttggcagaccgaccgcgaaatccggggaggtgaatgatgaaaaagttaacgtttaccgcactggcactgatgatgtgcggcgcggcatgggctgcggccataccgcaggcaagccgctatgactcccgcgtgcagcaggttatctataacccgcagaacgtcactgtcgttaacaccaaacccggctttatgacaacgctagtctttgataacgatgaggcggtcataagcgccaaacctggctttgatgaggcgtgggaagccacgccggatgcaaaccgggtcaacgttcgcccggtcgcgctcacgcagggagcgcccggagaagatggcaacacaacgcaggtcgtgatccccccgaacagccgggactggcataccaatatgctggttgtcaccagtaagcgcctgtacaacgtcgagctgaacgtcatcgatgataaatcggcacaacaacccgctttccaggtgagctatcgctatccgggcgaagaacgggacaaagcgagccgggaggcgacggccagacagcgcgagtgggagcagaaacagcaacaggccagcgtccagaaagcgctgaactcggcgcagacgccccgcaactggagttacaccaaatatccgggcaaaggcagtttcaacattgttcccgattttgcttacgacgatggccgctttacgttcgtgggcttctccccgtctaagtccattccttccgtcaccaaagagctgaacggcaaagagcatgtggttaacagcagtatccagaagaaaggcgatttcaccgtactggtgattcaggaggtgacgccacgcctagtactgcgttccggtaatgccgttgtgggtctggaaaatagcggatttggcaaggtacacgccgccgatggttccaccgtatcccggcaggtggaaagagtggaaaaaccggaatccaattaacctataaaaatatttttataaaaggaaacgtgcatatgaacgacgaaaacaaaatgcctgtgccggatgaagcgcaggcattcccggcacacgctgaggatgatattgccacgcttgagcgggaagcccgcgctaaaagggaggccgagcttctcaatgcgcaggacgacgaagagaaagacccggtacaacccgccgttaacaagctgaaaaagcgcaaacggggcaaagcaaccgcctttcttgccattgtcgcggtcacgcttatcttcctggcatggggtggtaactgggtttatcgcaatatcctgtggcagcctacggaagaaaagaaacaggacacagccccgcagacgaacaaaaccgattaccggcagcgtaacgatctcggtatgtccaccgatacagccgaagaagagccagagcaacaggataacggccagagcagcacggggggaacagggcaggtggctccggccgccccgccagaactcaacaaagccagcttccttattcgccgtgatggttcggccaccacacagaacccggtaaaaacccggcagcaggaaatgacgctgacatcggcaacgaccaccggacaacaggacagcagcgcggccacaaataccgccgcaccgccgccgggacaaagccccgcaccactgcgccgcataccctataaccctgacctgtacatcccggaaaatacctcgatcccctgctcactggatcgccgctttgtatctgaccgggcggggaaacttcgctgcacggtcactactgacatctggagcgccagcggcaacacgaagctgatagagaaaggcaccaccgcatcattactttaccgcgccatagcggaagaaggtatgaagcacgggcaagggcgggcattcatcattgcgacgaagctacgcacccgccagccgccttatctcgatatcccgttggttgataccagcgcggctggcgagctgggcgaggctggcgttgatggctggatagattcgcacttctgggaacggttcggcggcgcgttaatggtcggcatgatccccgatattggcgcatgggcatccaacagcgcgggtaaaaaagaccgcaatacggactatacggaaaacagccgccaggctatggcagatatggcacgtaccacgctagagaacagcatcaatattcccccaacgctctataagaatcagggcgagatcatcaacctaatcacaggcgaggatattgatttttccaacatctatacactgaggttgaaaaatgaccgctaagaatatttccctcgaccgctataaacagcgtttctttggcgactttctagagcttcccggcctgacggagatcgccgtcaatcgtccaggtgagctgtataccaaaatcaacggcgtatgggagcagcacgccgttcctttgtcctatgaggattgctacaactttgcccggtgcctggcaaagcaccacggcgacaatatcgaagatattaagccggggctgtcagccacgctggaatctggcgaacggtgccaggtgattgttcccccggcctgtgagcgcgatacggtgtctatcaccatccgtaagccatcgaaggtacaaatcccgcatcagtcatacatcgatgcgggattttataaccgggtaacaggcgaggaaaaaacggagacgcacgacgaggaattaattgcattgtacaatacaaaaaatattcctctgtttatggagaaatgcgtcgagtacggtaaaactctcgcggtcgccggggaaacaagcaccgggaaaaccacctatatgaaaatgttgatagggtatattcctgtacatcttcggatatcaaccattgaggacaacccggaaatcacgttctttatccataaaaactacgtccatcttttttatccgtcagaatcatcagatgaaaaaggttctatcgttaccccggcgagccttttacgctggaattaccgtatgaaccctgaccgcattttattaacagaggttcgcggtgcggaagcctgggacttccttaaaataacaggttccggccatgaagggagtatgacctccattcatgcaggatcagcgaaagaagctatagatgggtttattacccgttgctatgaaaatccacagtgcgcccagctcccctatacatttatgttacgtaaggttctggatagcctggacgtgattgtgagcattgatttagacggaaatgttcgccgtatgaatgacatctatttccgtccaattcatcgaaaccagtattttgaggaaatgaaagcatgataaagaaacttaaagtcatcatgttggcagcaatagttaccggatgttcatcgccgccgcctcccgttcctgtggagtgggataaagccgctgccccattaaataccagtttatcgcaatggagtgacaataacgttatagtcccttccccgacagttaacggtaaatggacatcatcaatcagcgcacaaagtttctacgatacaatatggactccagcagtattttacgcagtcgcccattcaacacgaattgtcgtcactgcacaatccggcactgatttctttaatgccaaaaactggcttcgccagaacggcgcaaaaggcgttattgaataccagcctgtctttaattgcctgacgtgcagagaaaccactatttatttctctcgctaatccatttaagcaacacaatctaataaggatttatcatgaaaaaaaccgttatcgcggcgacggtattatgcctgaccgcaggaacgccgatttattcctttgccgctgacccgtgcgaagttgttctttgcatgtacggaaaagctacaggtaatagtggtgggagtgaatgcagttcagcagaacgcgcattttttaaaatcaacgcatttaaaaaacaccatcgtttcaatccgggtaaaacattcgatatgcgaaaagaatttttaggggagtgcaaagccgcagaccctgaatcaataagtaaaatcctttcaaaatttggcagagtgaaaggataactgacatatccattttgatatgagaggttcgaaatgataaacgaagatttattcattaagaatatacactcaaaaaatcaggacagaatatctgtagccatggtatatgacacgttatcaaaagaagcccacagaggttgtgggctgtattacgaaatatacgaaagctgttttatcggtcttttgcgcgatcatctttcagaacttaatgaagctgacgcaaatagattaagacgctatgccgagagtaaaggtacgaaaattgatgatgcgtcctacagtgaagcactggaagctgaaagggagtgcagggctgaaatataccgcgagcaaatgtaatcacacaaaacaaaagtgtattgtacaatacagagactaacaggcgacgggattttaaggcttcattatttttggcttcaatttcgaagaaattgttaagacgaaaaataatgaagtggaacgtggacagaaaattcaatttcggagaaattgctaattttcaggatccacgtccacccgcgaacattcgccccagcgaattgaagcgggccggggggagccgcaaaaattttgccgccccagcgagcaaaaaggcacgcccacgtgccggtttttgtggggggcttgccccgcacaccgtcgcagccaggctatatttcccgccccggcggggaatatgccgattaggcgcgaccaacccctttaaagcagcgttcccattttttcgagcttgcgaagaaaaaataggctaaacgcgcgtcttaaaggggttggtcgcgcgtagcgtgcgacggtgtgccgcctttgaccctgggggttttggcgtggcgtccagccgcgacattacccccatgcgacaggcaataagggcgtccagcccgcatgtactggcgcacgccgtttcgtgcagggaagcatgctttccggtacatggccgcacagcggttaccttctttaccccatacgctcgccccgtcttttcgcccgacaccgtggggcgaattgatggggcgatgtcatggggcgaatcgctgacgaaggaggcatgatgattttaaataagcttaccgcttcactgtccccgatagtgaacgggatgctggcggtgctggcttttgtgcaacagaaacaactggtgctggcattattagcggggctgacgatgccgttttttgcatcaatgaaaagcgatgaacggcagaaagcgccgctctggaaaaagctgattattgctttttccctgctgtgttttctctccggcacactggctccggtcgttatcggatcctttcagtggctgtataagatcagacccaccagtgataatacggtactggcgtggtcagtacggattgctttcactgtaaccgggattatttttcatattatgcttcgccggatattcacaccggaactggacaaaataaagaaacgccttgttaaaaagaccacccttgaacgggaattgcgcaccgatgtccgcaccgtaaagtccctgctgccggaaacactgcattataacccgctggattatatcgacctgaataaaggcatttttaccggcatgggcagggaaaatgaaccaatgtatctcccgttaaaagactggcagaaacaacacgcggatattatcggcaccacaggggccggtaaaggggtagccgccggcatattactttatcaaagtattctggccggtgaaggtgtttttgttatggaccccaaagacgatgaatgggcaccgcatctttaccgcaaagcctgcgaggatgcaggcaagccttttgccttaattgacctgcgaaaacagcaataccagttaaatctgattgaagatatcacgcccgatgagctggaagaattgtttgttgcaggtttcagcctggcagaaaaagggcaggaatctgatttttatcgcattgatgaccgaaaagccgcccgtatagccgcacaatttgtcagcgataatccatcgacaacaatccgggatgtttataacggtgattacgttcagagtattgccgaaaagatcaaagcctttttcggaaaaattgaggaactggcattactcaatgccattaactcaccagaaggcttttcgcttaagcacatatttgatgagggcggctgctgttatgttgtcggctccatgcgaaacagcaaaattattaccgcccagcgcatgctactggttcgcctttaccagctggcagaaaagcgcgatcgagtaatagacgtcccccgccccattgctgtttatctttccgaactgaaataccatttatccaggtcagcactggagggattaggggcagcgcgtgataaaggcgtgcatattattatggaccaccagtccattgccgatttaaaagactgcccggcagatttgaaaggtgacgccgttgtcggtgcggtcgttgaaaatgccaaattcaaactggtttaccgggttatggacccggatacagcggaatgggtagcgagaatgtcaggcactattctggtggatgacgaactccgtaaggctaaaacagataatatgctcacggagaccatcgacagtgagcgcacaatccgccaggccgaacgtttctttattgacagcaatatgatcctgaacctgcccgattttgtcagctttatctttacgacaaaaacgctaccttctgcttcactgatctcgccgataaaggtcagaaagcgccagctaaaaactttttcggtttcccctgatattgccgcaacggtagcccccgtgaagatcatgctggatttttgcgaggatgataaacccgccatgtcggatgtgatgacaacacacccggctcttttcttcgacgaaagcgaagtcaaaccggtaaagccgaaacctgatgatgaagaacacctgtccccgctggatttttaaggagcgcttatgctgatttcatcatttcacgagcgccagacgcgtaacaacgaaaaaataaaacaactgctgaacttcctgaaagaagaaacttacagtgattttaaaactctgatgctgttatttggtttccgggatcataagtcgctttattcgctactggcaaaaacagagcgaatggggttaatccagaagcatgtgcttgaatcacgaacaatgaagatttcattatgggggatcaccagcgacgggctggcggtggtgttaaccccggatgataaaatctttcctcctcggtttgaaccatcaaaaatcaccggctggacgctggaacaccatcttgataatcaggccgccaggcttattctggagaagaaaggcgcgtcgggatggattaacggcgaccgggccacctttctcagccagtatcaggtaaaacatcgcccggacgggttgatcatcttgcctggcagcaccgtgatcgccattgaaaccgagcgtcgcctgaaaacccgagcccgctaccagtcgattattgccagccacctgctggcccgtacccgcaaactgtggattcatgttttttatgtcattcctgacccacagaaaaaacgggcacttgagctcctatttgacagcatcagacatgtcatcatcaaccatcagcacgtcccgctggaagaacgccaccgtcgggtatttcgcatttatacccttgatgaattaaagcgcttgtcattagacagctatacgtaagcttttactcaggccatcgtgatggtctcaccgggctggcggtaataccgccagcccggtatatttttattccactgcgaggcgcagactgttcggtactcgctatgctgcgttccgcctcagtctgcgccctgcagcgttgccggttaaaaaccatgtaaccgcattcccttgcggttgtctggctccgtcctcagagtttatccatcagataagaatgcgctttagaggcggcgctgaccgctttgaaaatataacgcttgtcgtttttcagcgctttcagccaggaagcaatatagctttcatgttgtacctctccctcaatgccaagatcagccatcagaaaggcacttcccagctccgcgacaagttcttcctctgcataatccgcactgccaaacttccctttcatttcacggttcaggcgttttttacccccgctccagtgaaccagctcatgcagaccggtagcgtagaagttagccgcatccgaaaacaaatggcgctccggtaaccagacttcatcagttgatgggctgaaaaaggcgttttgtcctttctcgatgatgtttgcgccactcttccgtaacaggttctcagcctgcggcaacgggttaaatgtagcttccgggctgactgtttcagttgtcaggggcaaaccgtcgatttgctgaacgttaaacacggtgaaagttttcagcatcggaatttgttcaacctctccggcgtcgttttccttttccagggtcgtatagaaaatggctgttgtgccatgttcacccttgcgaacctgtccacctgctgcctgtgcctgtttgtaagtcatccagcgggaatcgctgaaaccctgtttagatgcgctgcaccacagcaacatgatattcattccgctgtaagccgtgccagtggcgtaattggatggcagtccagacatgccggatacacgcagccacgggcaggaccacggttttacaccggcttccagcgctgcaatgatgctgtcggtaacggtctgataaatatccgttctggttttagaaaatttcgtttttgaggagcctgactgctccagcgaggatacgctggtcgccgctgcggtgttaggggcgcttgtccgggaggtataaagggaaatcgtcatggttttttctccgtcagtgtgtgattttcgtcttcgtatcgcctgacggttcgctttcccggcatcgttctgtcctgcaagggcgcagtatgcgtgcaattttacccttgcgggacgggttgtgttgggaaacgattaaccggaagcagatatgaagaacggaaaagcgcacgggagagaaaacctgcccctgcatagccgggcttaacgccccttacttcgcagcggtgaaattagattggtggtaatgagtcgggaaatggcattaacaggaggttcttgttgatgttagcatgctttcctgccggacgaggtgatactgctaaccaggggcgttttgttcttaaaatgcctcgttccggcatcaatcactaccgagtccctgccgtccccttattgagcgccgcgtacagtttattcactaccacccatagtgagcgatttagtgaaacaggccacagcgccgtaaccgcgggcatcatatgccgtagtggcgatctgtcttattctcagtgcccctctatcagtatgcgcccatgcaaactgacattccccctgtattatgttgacagggagagacctgccagcctactggcgtgacgttgcgacagacccgttgcctcacacatgacttccacagcttcccgcttctggtctgtcgtcagaactttcggttcagggccacctgcaacgcttctttatccatcatgacttctgcaagcaactccttgaggtgggcgttctcttcttcaaatgacttaagacgtttcacctcaggcatttccatgccatcaaacttcttgcgccaagtgtagtacgcagcatcagagatagcgtgcttgcggcaaagctcccgggcaaaaactccagattcagcttcgcggaggatactgatgatctgttcgtcggaaaaacgcttcttcattatgatgtcctcatgtgactaatgaagacgttactaacatcggtgtatgttaatcaatcgggagcagggcaaagccaccgtttgatgtttttttataacagtaagttataaacaaattgatagcttgatatgtattgagcctcaaaaaacacctattcgatggcaagctttaagaaaaggttctttaaggaaattgcattcagcataaggcttctttttcgcttgacgtgctaatgttctcatgaattcggtaggactcaacccctcctccttccactcatctagcacctgagtaagccagtatttaccgtcattttctgcacaaactttggctttataacgttcttctataccgtacaagtctttccatgtttctagttcctcctccagcgtatcgggaccgaactgtataataatatcagcaggctcaagcgcatcgatatttgcatgttgtagagtaatctgtaattgaattacatgatccactgaggcaaatggattgaaggccttacgacgaagagcgccgctctgaataggatctttggataacttatatgtgctattgcactcatgacaggccggagcaagattatggaaatttatcgaattaaatggatataaagctttgggcaaataatggtcataggcctcgcgcttgctatggttcccaccctttatatctccaataccacaaaaaggacatttacccgccttgttcactgctgcaaaagattgatagtgatcgtgtatatcaccgatcttggcacgcagtacagcgagatcaagcagtgactgtgagtataagcccttaaagaaaacagcaagttgttctgctatatctttgtggtgaatggcaatatcggaataacggacaacttgtattgaagggtcattagcacatattttttccagatcattattcccttgataccactgtttaaactgatcgatttgtacctcagtcagtgacgaaaacaagccataaattttctctacatggttataaaagaaaacagcaccttgtgtatccgaggaagaaaaatcctccatcacttcatacaattctgcgttagcttcaaacagtttaagacaaaaaggccctcttacccgcgctttgcaccatacctcataaaaaataaaatcaatgaatgcctgcatcttttccattttgtgtggcacataggtatatgaaaacagcatcagtgctaaacctcgtcattcgttggattgtcgctatcaaaaatagccttgaggagtaatactttttccaccgagtcacccaattgttcatcaatttctgtgatcagagtttccttgtcttcaatgccttcgttaaaacgtctgcgtaaatcatccagtactgcttgcgcatggccaccgatagtttcacgtttgccgaaggtattcatagtaattttattgattgatgcaccaagtgtgttgtatttaggtatgcttattgtgaccgcaccgctatatttatccttagaaaaaaccagtactttttcgggtttactatctgagataaggaaaggtgtatgagtagtgatcaacatttcctgctccacattctcagtgttacataaacattggcgcatccgagtgataaaactggcacgccaatgtgggttgaaatgagtctccggttcgtctaacagaaacaggctgttggtttctctaaacagtaaacatagacctaggctatgaagcaattggtgttcaccgtccgagagttccttgagcatcattggctcttccactccttgtttagtaaaacgcacaaacttgaagcgcataattcgttcgtcggacgccaacgttggtaccgtttcactgacatagtgacttgttgagcgatacagatcagttttgagattatcactcaccttatacaaattgagtgtcagcaatacttggaacgcctggaatagagccagtgccgaaccattaaaattctcgcgaaaagcctgtcgagtagcatcattaacccagtagtccagaattagagtgtcgttacactcgtcctcgtaatacaagctagcgcagcgtttaagcgcgctgactaccaaggaggatttgtcatccccttccagcagctgcatcaggtttaaatggtaactttgaccactttcttcatccatatccacatgcagagcagggttactattcaaaatgtcatcaagtgattggtgctggtttttatcctcgctggcaaacgaggtcaactgctccggcgcaagaggaatactgcgacggataataatacgaaactcccgcaacgcctctataccaacatcctcacggaaaggttgaagcgcagtttcgttttgaaaaagcagattacaaagtaaaatagcttggctgaaaccactgtcaagataggccaacctcgactccggatggccagagtagctcagttgtcgagtcaaggcattccagtactcgtcgaactgtacaaagcgcattttgaaaaacggtagactgagaatttcattctcgccagacgagtagcccaacacatactgaggcaatagaatatcggcatggcttcccttgaaaacttcatcagcatttgtgtcaaagtcactctgatttacccaatggaaacgcacagattccccgttgtttttccacacggagacttttgcccattcttgtccgccagagattcgaaactcttctggtactcgaattagataatccagctcaaatgagattggtgataaatcatgatcggtactttgcaatacctcaggcaaaaaacttcgacggacccgcaaaatttccaactgaaagaagatagctgctaatgcttcaagcagattggatttaccactgccgttgggaccagcacacacaaaaggcgcaaagccttcatgttgattcaattcttcctgtaaatcccattcggttctaaaatagtgttcaaaaccacagggcagactacggaagccggacggatcagagatttttaggcgtaatagcttcataccaaaaccgccttaagttcaatgcaattgtcagcgtcattgaatacctgcttcagtgtaccaatagccagagctttgaacacccaagctttgatatgctcatagtcactttcaccaaacttagaatcaacgtccggatataattccgccagccgtgcctgcgccgtcatcatgaactcatgtactgaaaacgatgagttgcccaattgcgctatataggcctctagccattcctcgatcagtgacttgcgagcctctgcattatccaacgcggatggtaagctattagttacgggcagataattacccactgctatatgttgtacggcatccccgtgttcaggttcttcacctgataccgggaaaaatatctgtgtcggaataggcacacgcgaaagttctaattcccccttgaaagccttttggctaacaacatcatacagggtctcaagatcagcaagactttgctgatagcgaaatttaatagcatgcgctttctctacaatagtagcgaatttattttgtaactccagtggaggcttaagaatagggatggcccttaactcttgggcattaatgttagccataccaataatattacgacaaagattaaataattttgcttttccaaactttgagttcaggtgcccccatacaaaccaagggttagtttgttgatcgaacctaacacgaatgagatagccagcaataataacagtttcatctcgatcgtaaaccgccgttttaccaaccaattcttttgaattggtccggttgaaaacgagatctcctttctgaagagaatatttatccagatccttattatctacatcgatatatttaagattctcaaaatcccagtaaccatccggagtaatgttattcatccgtatgtatttatattttccaccttgcgctgatacacttgtcccgtatcttacatcgacagctaactcacctattgttgttagttcccatccttttgcattttttaccggatcactaaacatatcgacgaatacgctctttagtaggtcatccaggtattgcaaaagttgtttacgctgttcaattagcccttctaccttggccaataaattagctatacgagcctgatcattgatgggaggaaaaggtacttccaaactaagaaaatcagacttcgtcaagctacgtctacgtgcaacaaccccttgcatacgagatgcatagagtcgccttgcctcggaggagcgcagataacgctcaaggtaagggatatggcataccgattcatccttgagtttccagataccataagctgggctaacgattcctaccggatattttgtctggaatccaagaactccctcgtcaataggaaacccaacaacaagttcattcttgtatacaatacgatatttagacgtgtctgaactggcaatccgcttcttgaatttgtctgattggtcaaccaaaccatttttcatggttattgataggaccggaagctctcgattgcctgcacggtggtgaccggattgagttaatatgtcaccaaggggaatagtcattctattcatactatcatcccctttaactctagtagctcgtacaagatgccactttgtactttattaagcactttcttatccacattccccacttctgcttgaattagtcgttccagaatagcttcaggctgttcgtactgcacttcttcaaatatttcttccttatagcgagacagcgaaagatcgtaattctccgcttcaatatctattcttggcaccataaaacacttagctgtacgatctgtgtcagacgcctcatcacgggaatggtatttttgaatgatgtcttgcaggtcgccgtagccttcaagcttatttcgtttgtcatccaatgagtaaccatcggaagacatctcataaaaccagacataatcggtagcaggtttggaaattttatcccccggcccgaaaactttggagaacaataaaatggcagtacttactccagcgtagggtttaaacactccactgggcagagtaatgacagccttgaggtcgcagcgctcaactaaagtttgccgtagttctttgaatgccttgcccgagccaaacaatactccttgaggcacaatcacacaggcggtaccgccctttttcagcaaacgatagatgttctcaacaaacaaaagttcggttttagtggttgagagtttcaaattctcattaatatcccccctgtctatactgccagtaaaaggcgggtttgctagcactatgtcatatttggtttcttcactatagctcttgcttagtgtgtcctgataatcaatatgcggctcatcaattccatgcatcattaagttcattaggcctaaacgcaccatagtagcgtcaatgtcataaccatacagactctcttgcaaaagaatccgggcctttttggtcagagcggcagtcacagaagtgcgaaagaacccatcttcatcatgagtagatccttttgaattatctctttttaagttttgagataaagacaactgagtaaggatgtactggtaggcacctaacagaaacccccccgtaccgcaggcagggtcggcaatacgttgtcccagttgcggctggaccagatctgccatcaatttaataatgtggcgtggtgtgcgaaattggccgttcttgcctgcggtggcgatttccgacagcaggaattcatatacatctccttgaatgtcttgaaaagcttggcctttttcttgagaatcccttttcatcatctcgaagatttcgtcaatggccttcactgcctccaccaacaatgctgactttgggataatgaatactgcgtttttcatgtgatgagtgaagttagattcagcaccattcagatctttcagaaaaggaaaaactttgtctcgcacatgttgcagcatctcttcgggctgcaatttcttgaactcgctccagcgaagcgtgcgtttatctatagggtgttgttccgcaacagggcggtttctttcctctggtggaatccaagtaccagcaaacttagaaatgtatttctcaccactcgtttcaccttcgtcttgccttttatgatcgagttcatctagccgtttcataaacaacaggtaggtaatctgttcaatggctgtgagcggattgctaatgccgctactccagaatttatcccagaggcgtttgatcgcgctttgaaggtcagggttgttttgtagcatgtggctgggttctcggttcagtctctattgaggtgctttgtggctggcagtttactcttttttcagaacattttcctttcttaaagtggcaacttaccagcccattttggctgcaccatgacataactatatgttttttagtaaaaatagctcaattagtaacagtattcataatgtcctatcggcgatgagtctcagtaaaccaccaaataataagcattatattctaccacaaagagataaaacagacaaaaacttatcattagaaggctttaaaagtgtaaatgtctaaaaagctcccgaaaagaggttatccaaaaatcgtagagctaccaacacgcccgctaaaatattcactaaattcagtgccaaaaaacatcgccattcacacaggatatccgacatgaaatgcatactccaactctgaacgatttgtgtaagagcggacggcatcaacattgccctgagatgtctgtggggcacgtcctatgtacattgattttttcaagacagtaaatgcagagtttttcctatgcttaacaagcaagcatcccgccactcagtaggcggataaagtgctagccatccaagtttcatacgcagggttaccatccaatcataacgacgcctcagcctgttctactttactgtagtaataagcatcgcatctacgctttgtcgcacactcattcgaaattggtggtcattatggtggtcttgacaggaagagcaacaaggtttagcttatttattagccagttattggcttgggcgatcccagtcagaggagccaaattctaaaaattcgcttttttagcgcaatgtcactgaccttagttgaacattgttttttaacggatagcgggtttttaacatcttaagcgccctcgacctttatggttgagggcgttttgctatgaacgccatcaccattttcccctcgattataaaacttgagttattcagtagtctcccctcttgcaactcacacccaaaactgcctaacgaaaagttattaattttcaatcatattgctatcagtatttacattttttcgctgtgctagaaagggcgcatttatgttagctcgttcagggaaggtaagcatggctacgaagaagagaagtggagaagaaataaatgaccgacaaatattatgcgggatgggaattaaactacgccgcttaactgcgggtatctgtctgataactcaacttgcgttccctatggctgcggcagcacaaggtgtggtaaacgccgcaacccaacaaccagttcctgcacaaattgccattgcaaatgccaatacggtgccctacacccttggagcgttggaatcggcccaaagcgttgccgaacgtttcggtatttcggtggctgagttacgcaaactcaaccagtttcgtacgtttgctcgaggttttgataatgtccgccagggtgatgaactggatgtcccggcacaagttagtgaaaaaaaattaaccccgccgccgggtaatagcagtgacaacctcgagcaacagatagccagtacttcacagcaaatcgggtctctgctcgccgaagatatgaacagcgagcaagcggcaaatatggcgcgtggatgggcctcttctcaggcttcaggcgcaatgacagactggttaagccgcttcggtaccgcaagaatcacgctgggcgtggatgaagattttagcctgaagaactcccagttcgattttctccatccgtggtatgaaacgcctgataatctctttttcagtcagcatactctccatcgtactgacgagcgtacgcagattaacaacggcttaggttggcgtcatttcactcccacatggatgtcgggcatcaacttctttttcgaccacgatcttagccgttaccactcccgcgccggcattggcgcggagtactggcgcgactatctaaaattaagcagtaacggctatttgcgactgaccaactggcgcagcgcacctgaactggacaacgattatgaagcacgcccggccaatggctgggatgtacgcgcagaaagctggctacccgcctggccgcaccttggcggtaaactggtctatgaacagtattatggcgatgaagtggccctgttcgataaagacgatcggcaaagtaatcctcatgccataaccgctggacttaactatacccccttcccgctgatgaccttcagcgcggagcaacgccagggtaaacagggcgaaaatgacacccgttttgccgtcgattttacctggcaacctggcagcgcaatgcagaaacagcttgacccgaatgaagtcgctgcacggcgtagccttgcaggcagccgttatgatctggtggatcgcaacaacaatatcgttctggaatatcgcaaaaaagaactggttcgcctgaccctgacagaccccgtgacagggaagtcaggagaagtgaaatcactggtttcgtcgctacaaaccaaatatgccctgaaaggctataacgtcgaagccaccgcactggaagctgccggtggcaaagtggtcacaacgggtaaagatattctggttaccctgccggcttaccggttcaccagtacgccagaaaccgataacacctggccgattgaagtcaccgccgaagatgccaaaggcaatttgtcgaatcgtgaacagagcatggtggtcgttcaggcacctacgctaagccagaaagattcctcggtatcgttaagtacccaaacattgaacgcggattcccattcaaccgccacactgacttttattgcgcatgatgcagcaggtaatcctgttgtcgggctggtgctctcgacgcgtcacgaaggtgttcaggacatcaccctttctgactggaaagataatggtgacggaagctatacccagatcctgaccacaggagcgatgtctggcacgctgacgctgatgccacagctgaatggtgtggatgcggctaaagcccccgccgtggtgaatatcatttctgtttcgtcatcccgaactcactcgtcaattaagattgataaggaccgttatctctccggcaatcctatcgaggtgacggtagaactgagagatgaaaatgacaaacctgttaaggaacaaaaacagcaactgaataacgcagtcagcatcgacaacgtgaaaccaggagtcactacagactggaaagaaaccgcagatggcgtctataaggcgacctataccgcctataccaaaggcagtggacttactgcgaagctattaatgcaaaactggaatgaagatttgcataccgctggatttatcatcgacgccaacccgcagtcagcgaaaattgcgacattatctgccagcaataatggtgtgctcgccaatgagaatgcagcaaacaccgtctcggtcaatgtcgctgatgaaggaagcaacccaatcaatgatcataccgtcacgtttgcggtattaagcggatcggcaacttccttcaacaatcaaaacaccgcaaaaacggatgttaatggtctggcgacttttgatctgaaaagtagtaagcaggaagacaacacggttgaagtcacccttgaaaatggcgtgaaacaaacgttaatcgtcagttttgtcggcgactcgagtaccgcgcaggttgatctgcagaagtcgaaaaatgaagtggttgctgacggcaatgacagcgtcacaatgaccgcgaccgtccgggatgcaaaaggcaacctgctcaatgacgtcatggtcactttcaatgttaattcagcagaggcgaaactgagccaaaccgaagtgaatagccacgacgggatcgccacagctacgctgaccagtttgaaaaatggtgattatagggttacggcctctgtgagctctggttcccaggctaatcaacaggtgaattttatcggtgatcaaagtactgctgccctgaccctcagtgtgccttcaggtgatatcaccgtcaccaacacagctccgcaatatatgactgcaaccttgcaggataaaaatggcaacccactaaaagataaagaaatcaccttctctgtgccaaacgacgtcgcaagtaagttctcgattagcaacggaggaaaaggcatgacggatagtaacggggttgcaatcgcctccctgaccggcacgttagcgggcacgcatatgatcatggctcgtctggctaacagcaatgtcagcgatgcacagccaatgacgtttgtggcggataaagacagagcggttgtcgttttgcaaacatcgaaagcggaaatcattgggaatggcgtggatgagacaactctgacagcaacagtgaaagatccgtcgaatcatccggtggcggggataacggtaaacttcaccatgccacaggacgttgcggcaaactttacccttgaaaataacggtattgccatcactcaggccaatggggaagcgcatgtcacgctgaaaggtaaaaaagcgggcacgcatacggttaccgcaacgctgggtaataacaataccagtgattcgcagccggtaacatttgtggcggacaaagcctcggctcaggttgtcctgcagatatcaaaagatgagatcacaggtaatggcgtcgatagcgcaacgctaactgcaacggttaaagatcagttcgacaatgaggtgaataatcttccggtaacattcagctcagcctcttcaggactcaccctgaccccgggagtaagtaataccaacgagtctggcatcgcgcaggccactctcgcaggcgttgcctttggtgagaagacggttactgcatcactggctaataatggtgccagcgacaacaaaactgtgcattttattggcgacacagcggcggcaaaaattatcgagttgacgcctgtcccagacagcataatcgccggtaccccgcagaacagctccggcagcgtcatcaccgccacagtcgttgataataatggctttccggtgaaaggtgtgactgtgaacttcaccagcaacgcagcgacagccgaaatgacgaacggcggtcaagccgtgacgaacgaacagggtaaggctaccgtcacttataccaatacccgctcctcgatagaatcaggagcgagaccggataccgttgaggccagtctggaaaatggtagctccacgcttagcacatcaattaatgtcaacgctgatgcgtctacggcacatctcaccttgctacaggcactttttgatacagtctccgcaggcgagacaaccagtctgtatattgaggtgaaggataattacggcaacggtgtcccccagcaggaggtaaccctcagcgtttcaccaagtgaaggcgtgacccccagtaataacgctatatatactaccaaccacgacggcaatttttacgcaagctttaccgctacaaaagccggggtttatcaattgacggcaaccctcgaaaatggcgattcgatgcaacaaacagtgacctatgtgccgaacgtcgcgaatgctgaaatcacgctggcagcctcgaaggatccggtgattgccgacaataacgatctcacgacactaacagcaacagtcgctgatacagagggcaatgcgatagccaacactgaggtaacatttactctgccggaagatgtgaaggcgaacttcacgctgagcgatggcggtaaagtgattactgatgctgaaggcaaagcgaaagtcacgctgaaaggtacaaaagcaggcgctcatactgttacagcatcgatgactggcggtaagagtgagcagttggtggtgaactttattgcggatacgctcactgcacaggttaatcttaacgttaccgaggacaattttatcgctaataacgtcgggatgaccaggctgcaggcaacagtgactgatggaaacggcaacccgttagccaatgaggcggtgacattcacgctaccggcagatgtgagcgcaagctttactctcggacaaggcggttccgccattactgatatcaacggcaaggctgaagttacactgagcggtacaaaatccggcacctaccccgtgacagttagcgtgaacaattatggtgtcagtgatacgaaacaggtgactttgattgccgatgctggtaccgcaaaactagcctccttaacctctgtatactcattcgtcgtcagcacgaccgagggcgcaaccatgacggcaagcgtcactgacgctaacggcaacccggtagaaggcataaaagttaatttccgcggaacctccgtcacgctaagcagcaccagcgttgaaacggatgatcggggtttcgctgaaattcttgtgacaagcaccgaggtcggactgaaaacagtttcagcctctctggcagataaacctactgaagtcatctcgcgattactgaatgccagtgcagatgttaattctgcgacgattaccagtctggagataccggaaggtcaggtaatggtcgcacaagacgtagcagttaaagctcacgttaacgaccagtttggcaacccggttgcgcatcaacccgtgacattcagtgcagagccatcctcgcaaatgatcatcagccagaatacggtctctactaatacgcagggtgtagccgaggtcaccatgacgcccgaaagaaacggttcgtatatggtgaaagcatccctgccgaatggagcctcacttgagaaacaactggaggctattgatgaaaaactgacactcacggcgtccagtccgcttatcggtgtctatgcccctacaggcgctactctgacggcaacgctaacctctgcaaatggcactccagtggagggtcaggtcatcaactttagcgtaacgccagaaggggcgacgttaagtggcggaaaagtgagaactaactcttcaggtcaggctccagtcgttttgaccagcaataaagtcggtacatatacggtgactgcatctttccataacggcgtaacaatacagacacagacaaccgtgaaagtcactggcaactcaagcaccgcccatgttgctagctttatcgctgatccatcgactatcgccgccaccaacactgatttaagtaccttaaaggcaacggttgaggatggcagtggtaacctgatcgaaggtctcactgtgtacttcgccttaaaaagcggctctgccacattaacgtcattaacagcggtgaccgatcaaaacggaatcgcgacaacaagcgtgaaaggagcgatgacaggtagcgtcacggtaagcgcagtcacgaccgctggtggaatgcaaacagtagatataacgctggtggctggcccggcagacacctcgcagtccgtccttaagagcaatcggtcatcactgaaaggggactataccgatagtgctgaattacgtcttgttctgcacgatatatcaggcaatccgatcaaagtttctgaagggatggaatttgtgcaatcaggtactaacgtgccctatataaaaattagcgcaattgattacagtctaaatatcaacggtgattacaaagccactgttacaggaggcggagagggtatcgcaacgctgatccctgtattgaatggtgttcatcaagctggtctgagtaccacaatacaattcactcgcgcagaagacaaaataatgagcggtacagtatcagtcaatggtactgacctaccgacaactacattcccttcgcaggggttcaccggggcgtattatcagttgaataatgacaactttgccccaggaaaaacggcggctgattatgagttttcaagctctgcctcctgggtcgatgttgatgctaccggtaaagtgacatttaaaaatgtcggcagcaattcggaaaggattacggcgacgccaaaatcaggaggccctagctatgtatacgaaatccgtgtgaagagttggtgggtgaacgccggcgaggctttcatgatatacagccttgctgaaaatttttgcagcagcaatggctacacgctccccagagcaaactatttaaaccactgtagttcccgaggcatcgggtcactgtacagtgaatggggagatatggggcattacacgactgacgctggttttcaatcaaatatgtattggtcatctagtcccgcaaactcaagcgaacaatacgtagtttccctggcaacaggtgatcaaagcgtatttgaaaagcttgggtttgcttatgcgacatgttataaaaacctgtgattttccgttataatttcttaaagagtgttccattcggggcactcttttttacattccctctacagaactagcccttctctcacagaaaatgaataaataaaaatgcggcaccgccagaatcgcgttcgatgtgactatgatcattttcggtgagtactgctttgatctaaaggctggttttctgtgatgattgaccagcctcagagtattgatgacaccaccgttcataacagatcggcattactatgcataagtactgtctcatattctcgccaaaacactttttaatgcctttgcgaattcatccagacttatattgtcaattttttgcccaacgacgactgactccgagacatcggccattgcgggccatcgcgttttgtaatcagcataaattgcaacaacaggggtattataggcacttgccatatgtaatattgaggtgtcaggagttattgcgatataagcatcttttatgattgctgctgaacgtttaatcgagggtggtaaggataaacggtagacattattataacaatccactaatgccctggctttatcttcacctttgggtccatgaacgatcactattggtatatctgtttcactttaaatttttgctattagattttctgcaatcgataatgaaaatgtacgttcctgcgagctaccttctaaattgaacgcaatgtaagatcctaacgatcgcatttcctcgcgcacctcatcgagtacatcctcacttagtggcaattcatatattggcctgactgctggaaaacccgcctcacgcatcataaatgcccatgtcataggtacgggagcccggagtttctgatccatacgggacgcgttcttgcacaaaggggagaagcaattcatggttataccaacaacctgaaaattcgtttttgctttcaactgactgataaataacatcgttttcaggttctttttacgcatcccctcaatgcaaagatccggcgtaccgtattgctgtgttatgttctttgctaaatcttttatttcttttaatgttgcgtgatcctgcatagtcattgtgactaatgttaatttagtctgttcaagtttaagcgcattaaagacttctaaattaattgtcgacgttacaattaaaagatgcttaattttatgcaattcaagcgcccgaataacaggaaagatggccatagcatcgccaatctgatcgggaatatggatgacaacaaagtctgttttttcaatattgaaattataagctttataatcgtagtaactaaatgcaatacgtctcaacaatgatgctaaaaacatacctaacctcgcctccctactggttataatgcaatgcagtctatcagactcatcagggtgccattttgtgcatatgcggacttttatgtttcatatctctaacctgtgggtcctctgcttaatccttaaacaacaccagcaactcctgcgctttcatcttccatcgaatttttcatgttgccgctaatcagccataaaatcatttgcagatgcgctctgtcgaggtagtctcataaggttcgtttatagatcgacggcaatgtgagttaccttttccatactaattataaaaagacagtacaaacaggatcattatggactccacgctcatctccactcgtcccgatgaagggacgctttcgttaagtcgcgcccgacgagctgcgttaggcagcttcgctggtgccgtcgtcgactggtatgattttttactctatggcatcaccgccgcactggtgtttaatcgcgagtttttcccgcaagtaagcccggcgatgggaacgctcgccgcatttgctacctttggcgtcggatttcttttccgtccgctcggcggtgtcattttcggtcactttggcgaccgactgggacgtaagcgcatgttaatgctgaccgtctggatgatgggcatcgcgacagccttgattggtattcttccttcattctcgaccattgggtggtgggcacctattttgctggtgacactgcgtgccattcagggatttgcagtcggcggcgaatggggaggcgcggcgttgctttccgttgaaagtgcaccgaaaaataaaaaagccttttacagtagcggtgtacaagttggctacggtgtaggtttactgctttcaaccggactggtttcattgatcagtatgatgacgactgacgaacagtttttaagctggggctggcgcattcctttcctgtttagcatcgtactggtactgggagcattgtgggtgcgcaatggcatggaggagtccgcggaatttgaacaacagcaacattatcaagctgccgcgaaaaaacgcatcccggttatcgaagcgctgttacgacatcccggtgctttcctgaagattattgcgctacgactgtgcgaattgctgacgatgtacatcgttactgcctttgcacttaattattcaacccagaatatggggctaccgcgcgaacttttccttaatattggtttgctggtaggtggattaagctgcctgacaattccctgttttgcctggcttgccgatcgttttggtcgccgtagggtttatatcacaggtacgttaatcggaacgttgagcgcatttcctttctttatggcgcttgaagcacaatctattttctggatagttttcttctccataatgctggcaaacattgcgcatgacatggtggtgtgtgtgcaacaaccgatgtttaccgaaatgtttggtgccagttatcgctatagtggcgctggagtcggttatcaggttgccagtgtggttggcggtggatttacaccttttattgccgctgcactcatcacttactttgccgggaactggcatagcgtcgccatttatttgctggctggatgcctgatttccgcaatgaccgctttgttgatgaaagacagtcaacgcgcttgatagcctggcgaagatcatccgatcttcgccttacacttttgtttcacatttctgtgacatactatcggatgtgcggtaattgtatggaacaggagacacacatgaataataagggctccggtctgaccccagctcaggcactggataaactcgacgcgctgtatgagcaatctgtagtcgcattacgcaacgccattggcaactatattacaagtggcgaattacctgatgaaaacgcccgcaaacaaggtctttttgtctatccatcactgaccgtaacctgggacggtagcacaaccaatccccccaaaacgcgcgcatttggtcgctttacccacgcaggcagctacaccaccacgattactcgccctactctctttcgttcgtatcttaatgaacaacttacgttgctgtatcaggattatggtgcgcatatctcagtgcaaccctcgcagcatgaaatcccttatccttatgtcatcgatggctctgaattgacacttgatcgctcaatgagcgctgggttaactcgctacttcccgacaacagaactggcgcaaattggcgatgaaactgcagacggcatttatcatccaactgaattctccccgctatcgcattttgatgcgcgccgcgtcgatttttccctcgcacggttgcgccattataccggtacgccagttgaacattttcagccgttcgtcttgtttaccaactacacacgttatgtggatgaattcgttcgttggggatgcagccagatcctcgatcctgatagtccctacattgccctttcttgtgctggcgggaactggatcaccgccgaaaccgaagcgccagaagaagccatttccgaccttgcatggaaaaaacatcagatgccagcatggcatttaattaccgccgatggtcagggtattactctggtgaatattggcgtgggaccgtcaaatgctaaaaccatctgcgatcatctggcagtgctacgcccggatgtctggttgatgattggtcactgtggcggattacgtgaaagtcaggccattggcgattatgtacttgcacacgcttatttacgcgatgaccacgttcttgatgcggttctgccgcccgatattcctattccgagcattgctgaagtgcaacgtgcgctttatgacgccaccaagctggtgagcggcaggcccggtgaggaagtcaaacagcggctacgtactggtactgtggtaaccacagatgacaggaactgggaattacgttactcagcttctgcacttcgttttaacttaagccgggccgtagcaattgatatggaaagtgcaaccattgccgcgcaaggatatcgtttccgcgtgccatacgggacactactgtgtgtttcagataaaccgttgcatggcgagattaaacttcccggccaggctaaccgtttttatgaaggcgctatttccgaacatctgcaaattggcattcgggcgatcgatttgctgcgcgcagaaggcgaccgactgcattcgcgtaaattacgaacctttaatgagccgccgttccgataataagttctgaaccttcttatcagaaatagatgtgaaggagtaagtaagacacctggcaaatagcctgcaataatcgtgggctgtttgcttccttgggcggatacgagttttattatcgtcttaatgatttccacatattaaaagcaagtatgctttcaaaacacaattataaaaaatcccgccaacaatataagtttttataaaattaaatataagattatggctttagaatatttttatttctaatagacgagatttttcctgttatgatataatatgctgaattaacacatgttaacgatttaccagtaatgtaaataaattttcgaggagatcattccagtgggacgtaaatgggccaatattgttgctaaaaaaacggctaaagacggtgcaacgtctaaaatttatgcaaaattcggtgtagaaatctatgctgctgctaaacaaggtgaacccgatccagaattaaacacatctttaaaattcgttattgaacgtgcaaagcaggcacaagttccaaagcacgttattgataaagcaattgataaagccaaaggcggcggagatgaaacgttcgtgcagggacgttatgaaggctttggtcctaatggctcaatgattatcgccgagacattgacttcaaatgttaaccgtacgattgctaacgttcgcacaattttcaataaaaaaggcggcaatatcggagcggcaggttctgtcagctatatgtttgacaatacgggtgtgattgtatttaaagggacagaccctgaccatatttttgaaattttacttgaagctgaagttgatgttcgtgatgtgactgaagaagaaggtaacattgttatttatactgaacctactgaccttcataaaggaatcgcggctctaaaagcagctggaatcactgagttctcaacaacagaattagaaatgattgctcaatctgaagttgagctttccccagaagatttagaaatctttgaagggcttgttgatgcccttgaagatgacgacgatgtacaaaaagtttatcataacgtcgcaaatctctaattatcttttaaagaaatctgtctttacggcagatttctttaatctcatataattcttataaaaaatataatattcaactcgtcatattgattatacccccccgttcccagaaaaataatatttattaaaattccagttcttctttttctgattacagaaggcaaagtggcaattacgcatagtttcccgataaagacgcgatagcgacatcccgcataaggcatttttctctttatctttgtacggtacttcatggaacagagtttttgaccttgcgaatcgtgatgtctgttggggagggacaatttgctcactgaagcgtgagactcgattaagcgcacgaaacacagaaatcaaaaaacccggtcacttttttacaaggtaaccgggtaaaaataatttttattttttaactgttttgagactcatagagatgtctcaaaactaaaatttggctcctctgactggactcgaaccagtgacatacggattaacagtccgccgttctaccgactgaactacagaggaatcgtgagaacgaggcgaatattagcgatgcccacccacaatgtcaaagcctgttttttaaatttgaaatcgtttgctgaaataatctgcattttgtcgtttattccgacacaactggctttttttcacacttttgcggctcgggtcgagggtatttccatagccaacgtccagtaaccattcgccagtaaaacagcacggcccgcacagccccgtcggcaaacattcccatccagacaccaaccacaccccagccaagcatgattcccagcacataaccgactacaacccgacaaccccacatgctcaacatcgaaacccacatggcgtaacgggcatcacgagcacctttaaatccagcgggtagcacccatgaggcggaccaaataggcataaataaagcatttagccaaatcagaatcacaacgacatgtttaacctgtggatcctgggtgtaaaacgatgccataaccccggcaaagggagccgttagccaggcgatggccgttaatccaagagtggaaagccagaacacatgccgcaactgaatctctgcttgcgctatctgccctacccccaaccttcggcctgtaatgatcgtagaagcagagccgagcgcacttccgggtaagttgataagagccgcaattgaaaacgcgataaaatttccggcaataacactggtccccatcccggcaacgaacatttgggttaataaccgaccactggtaaataacactgattcgacactcgcgggaataccaatccccatgacttcccagataatgctaaaattcagcggtttaaaatagctctttaacgaaatccttagcgcaggattaaaaccaatcgccagcacccacaaaattgcaactgcgccaatataacgagaaatggttaaacccagccctgccccgacaaatcccagtcccggccaggagaaaaggccgtaaatcaatatgccgctaataataatattaagaatattcaggctaccgttaatcaatagcggtattttcgtattccctgcaccacgaagtgccccgctaccaataagagtgatggcagctgctggataactgagtaccgtcagctccagataagtcaacgccagtgctttaacttctgtcgtggcatcacccgcgacgaaatcaataatttgttcgccaaaatgatgaataagcgttgccaacagtacggcaaacaacgtcatgatcaccaatgactgccgcgtcgccaccctcgctcgtcgtcgatcccgcttaccgagactaaatgccacaacgacagtagtaccaagatcgatagcagcaaaaaaagccataatgaccatattgaagctgtccgccaatcccacgccggccatcgcatcttttcccagccagctgaccagaaaagtgctcagaacccccatcaacaggacacaggcattctccatgaagataggaacagcaagcggggttatctcgcgccagaacaacactttgtagctcttgcgtttagcgtgccagcgagtgccgtgaacaacctggcgtaaagcagaggagatattcaaagccgaccttaattgcagaaagtgaaaccacatttcaaataatgagggagaatcagcaaagctgcaaagattttcgccaacaaattgtctgcaaatgcaacaaactgttgatagaaacggcaaacagttggggaatttaaaaatcgggtttgacaaaagatttttcgccgttaagatgtgcctcaacaacgattcctctgtagttcagtcggtagaacggcggactgttaatccgtatgtcactggttcgagtccagtcagaggagccattttcaagaaagcagacgttcactgacgtctgctttctgcgtttctatcaattggttatccctcttcagtagttcaccctcgttcactaaaaaccactcgaagccatatcattttgatggtaaaaatgctggtaatgctggttcgatttcccttttaccaacaaatgagggggtgttttcatgtcactgactgatattaaagcaaaaaatgcaaaaccccttgagaaggaatacaagctgactgatggctttggtatgttccttcgtgttacccctaaaggttcgaaatactggcaaatggcttaccgcttcgaagggaaacaaaaactcttctctattggtgtttaccctgcagtttctctttctgacgcaagacaacgccgtgacgaggccagaaggcttctggctcagggtattgaccctaatgcaaagaaacaggcagaggttaaagagcttaaagccaaacgtgataatacacgctccttcagaacagtagccaaagcgtggttctctacgaaaacaaaatggtctgatgattatggtgatgccgtatggaagcgccttgaaacttatgtcttcccggtaatcggtgacaaagatgttgccgaactggatacgggtgatctgctggttccggtgaaaaaagtggaggcacttggttatcttgaagttgccatgcgcattcaacaatacattacggcaatcctgcgtcatgccgtccagcaaaagctgatacgccataacccagcctatgatatggaaggtgcagttcagaaaccacaaactgaacaccgccctgcacttgagctggaagaaataccccagctacttaacaaaattgccgaatacaaaggccgcaggttaaccatactggcaatacagctcaatctgatgattttcattcgttccagtgagttgcgtttcgctcgctggtctgaaattgatttcaaaagtaagttatgggtgatacccgaacagcgtgaagcaattgaaaacgtcaaacattcgactcgtggggctaaaatgaagcgtaagcacttcgttcccctttgtaagcaggccatgaagatactcaaagagatccgacaactgacttatgaagaaggccatgatgatggattaatcttcactggctgttatgactcgtttaaacccatgagtgaaaacaccatcaacaaagccctgcgtaatatgggatataacacgaagcaggacatctgtggacacggtttccgcactctggcctgtagtgccttaattgagtccgggctatggtcagaagacgctgtggagcttcaaatgagccataaggaaagcaacagcgtccgtgctgcttatacccacaaggcaaaacatcttgagcaacgtcgcctgatgctccaatggtgggctgactaccttgatgcaagcagaaacggtatggtaaggccgtttgagtttgctacaaataaataaagggaaaggccgttcgcggcctttcaacttcatgcttaattacagtctatgctgaatatgatactgaatctttttctatcgctaaaccagcgattttttccagcattatttcccagagtgcgtattttcttttgtgctcaataaacagagattttaaatactcttctgttgaagggattttttcagtccatgcaatatctttactgtaatcaatgctttttttcatatcagatgccgcatagctgtagtatttactctgagaacgactgatactgtcctctgccagcactctacggagcagagttgcagaacatgcataaccatgcctgtaaagctcactcgataaggtacgaacaaaagaaccgcgtaataaagacatcatctctgcgatttcatcttcactcgcattcatgacttcagaatcaagttttccataactatctgtcccggacaagaaaagaataacaaacggaaagccttttttctttgctatgccagagaacaaatccagtgagtcattatttttctccacccgattatagatattataaaaaataacatcacacctgttcttaaatccgtctatacaaattgtttttgcctgctgaatctcgccttcttcaatcaacgccagagccaacacctcagtccatttatcacgaagccctgcctgatcaactgatttatcttctttgattttattgagaacctgaatggcctcctcagtacacagttcatcaaccagcaactcagcaaacttaatgatatattctggatgattcagttttcttttctcaaagcattgcctgatgaaatcaacatccctgatatacagacttaactcaacagcaccattgacatcacctgtcttaagaagactttcccttaaaacacgaataacattgtatcccagttcttttttatacttatcaaaaatatcaaagttaaaatacacatcacctttaagtacggaaattattttatccgctataacatcaatgcttttgtctttttgtagggacagggattttaaccatatttcgacagcaccattataatagtccatccatgatccatctgatgtatctgcaatttcgctgactttatcaaatgagagcagtaaatcatggcaaaacgcctcggttttttcaggcagcgttgataccgtcttttcaagtggaaatatgacattcctgtatagcccctcaaaaaaaatcgctgcttcataataatcataaaagcgttttgttttaattacccttttgtattcagcctcagcctttttcagtgattcttctggagttaacagatatttattaataagaaaggattttgcctgaccattatcctctgcaatatcacaaattatttgcatgagttgttctgcaggcatttccttgagtaaagaaagttgtttcttgttcagtttagccatcatcacatcctgataatgtttggtagacgcagaaaagctaattgtactaatacaaggacaggacattcaataaatgcattaacataatgatttaaaaagaaatctgtagcacactgttcattgatgaaatgcactatttaccgtaaaatatcccccatcacacagtaacctgatacagatacgtggaatggtcaatgaacaaactttcgcctgaaatgcccgaactgcaatcaatgaatatcactgccgataacatcaccaagcttaaatcattgtttcctgaagcctttaatgaaaacggcattgattttgacgttttaaaacagcttttgggtgaaaatgtagacgaaaaagaagaacgctatggcctgaactggcatggtaagcgtcaggctcgtcagcttgctcttaccccttcccgtggcaccttacgcccatgtaaagatgaaagtgttgattggcataacaccaaaaacctcatgatcgaaggtgataaccttgaagtgttaaagcttcttcaaaaaagttatgccggaaaagtgaagcttatttacatcgatccgccttacaataccggtaaagattttgtctatcctgacaacttccaagataatatgaaaaattatcttgaaattactggacagacagaagacggagcacgtttaagcacaaatacagaaaccagtgggcgttaccatactgattggttaaatatgatttacccacgtttaaaacttgcaagaaacttgttgaaagaagatggggttattttcatttccattgatgatactgaagttgataatttaaaaaaagtttgctcggaaatttttggtgaagagaactttgttgctaatattgtatggcaaaaaaagtactcaccacaaaatgatgcaacatattttagtgatatgcatgatcatattttagtatatgcaaagcaacggaagagttcaaaaaatgattcaaacggttggaacatagattttctaccaagatcagacgaacaaaatgcagcatataaaaaccccgacaatgaccctcgtggagtgtggaagtctgtagatttatcagtcaaaacttattccaaggctaatgattactcaattaccacaccatcaggacgtattgtaactcctcccgccagtagatgctggcaggtttctgaaaaacgttttgtagaattgtgtaaagaaaataaaatttggtttggagaaaatggtaataatgttccatcaatcaaaagattcctgactgaggtccaagatggtgttgttcctacaacatggtggtcatataaagaatgtggacataatcaagaggccaagcaggaactaaaaaaactcatggagggagaatctgtattctttgacacacctaagccattgagattattagatagaatattacacttagcaacaaccaatgataaagattgtattatcctagattttttcgcagggtcaggtaccacggctcacgcaactttgaataaaaatattgctgacagtggttcacgccgatatattgctgtgcaattacctgaaaaaatagatgatgaaaaatactatacaatatcagaattaaccaaagaacgcctccgccgcgctggtaaaaaggttcgtgaagacaatccagagtggaaaggtgatgttggttttcgtgttttcaaactcgatacatctaatatccgtccgtgggaagccacagcagaaaccctttcagaacagattgatgcctatgtaagcccaatccttgaaggccgtagtgaagaagatttgctcacagagttaatgctaaagcgtggcattgacttgagtgtaaacattgaaatccgtcagtttgatggattaaccgtttcttgcgttgacggtggcaaattgtttacctgctttgctaaacaaatccctgcatcttcagtagaagaactgaccaaggggatcatcgactggcataagagtttaaaagttgggaaagatacggtctgctatttcctagatgatgcgtttgaaaataacgtcgccaaaacaaatctttgcgccattctggaacaacacggcctgactaacctgcacagcctgtaagggaatgagatgaaactacattttgaatctgaccttacctatcagcaaaacgccataacttcggtctgtgatttgtttgtgggacaggagaagtgggagagcgaaatgactgtgctggccccagctcagggtgcactctcatttgaaggcgcaacaggttcaatgcctgtaaacccacagatacccgaagatgatgttctgctgaaaaacctgaacaatgttcagttaaaaaaccagcttccaccttcacctgtgctcgacagccatgattttactgtcgagatggaaacagggacaggtaagacgtatgtttatcttcgcaccatgcttgagttgaataaacgatatggcatgagcaaatttatcatcgtagttccttccgttgccatcaaggaaggcgtttataaaacactacaaattactgaagagcatttcaaaagcctgtatgcgggagttccatacgaatactatctgtatgattcggcaaaacctgcggatgttcgaaattttgcaaccagttctgttatgcagatcatggtaatgactgtgggtgcgattaacaaaaaagatgttaacaagctctatcagtccagtgaaaaaacaactgtggacgatctggataagcccattgatttaatccgtgctacacgtccaattattattgtcgatgaaccgcaaagtgttgatggtggcttaaatggtgcaggtaaaaccgcacttgatgctatgcacccaatgtttaccttacgctattcagcgacacatgtgcataaacatcatatggtgtatcgcctcgatgccattgatgcttacaatcagaaactggtgaaacaaatcgaagttgccgggcttgaagtccagaatgcaagcaatagcccctatgtaaaactggtcagtattaacagtaagaagaatagcattagcgcgactgttattgttgatatagccgataaaaaagggaatgtaactcgttctgaaattaccgtgcatgacggtatgacacttgatgacgaaacggggcgtgatatttatcagggatacaggataagtgagatccgcacgggcaaagaaggctatctgacactggagacgccttctaatacctactatatgcaagtgggtgatgtcgtgggtgatattgacccgatgctcatccagcgtcatatgattaggcgtacaattcgtgaacatcttgataaagaacttcgcctgaattcccagcaaatcaaggttctcaccctgttcttcattgataaggttgatttctatcgccagactaatgaagaaggacttcgtgaaccgggtgaatatgctcgtatctttgaagaagaatatctaaaagcgatcaaaagccccgcatataaagatttgctcccttctcatccagaacatgctaaagacgttcatgatggttatttctccattgataaaaaaggtggatgggctgaaacaaccgaaagcaataatgcaggccgcgaaaatgcggaacgcggttataacctcatcatgaaaaataaagagaagcttttgagtttctcgaatccagtgaggtttattttttcacactctgctttgaaagaaggctgggataaccccaatgtattccagatctgtagccttcgagagatgggaagtgaacgagaacgtcgtcaaacattagggcgtggtcttcgcctgtgtgttaaccaagagggtgaacgtgttcgtgatgacagcattaacattctgactgtaattgccagtgaaaattatgaagcctatgctgaacgactacagagtgaaattgagaacgaaacaggcatccgttttggtatcatcgaaaaagatgcgtttgcacatctgatcgcctctgattacccgcaaggtgtaggtatcgcaggttcacatgagatttgggctgaactccagactgaaggttatctggaaaagtcgggaaaaataactaaagcactgaaagaagcccttttcaaaaacacttttgctgttggcgagaagtacgccttactacaggaacaaattgaaactatcctacgtaaatcagcagggcgactcaatataaacaatgctgatgagcgtaaaacaatcaaataccggaaagaagtcttaaacagcccggaattcgaagcgttatggcagcgcatttgtcaaaaaacgctgtaccgtctggcatttgatgaagatgaattgattaaatcctgtacgaaatcactttctgaaatgcagcctgtagcgaaagcaatggtcagtttcagcaaagcaacaatcaaacaaagtcagtcaggtcttgatgttaaggcgaagactaatggtacgacaagctctgttattgatgttgcagagcagccactaccagatattcttggtgttctacaggaaaaaaccggactgacaagacgcagtttatgcaccatcctgaaagagagtgaaaaacttgctgattttgctaaaaatccacagcagttcatcagtgaagctataggccgaatcaactactgtaaacgcctgtcaattgttgatggtattaaatattatccactaaaaggagaggtgtatgcgcaaagtctctttatggataaggagctaacaggatatgcccgcaatcttttcgaaacctcgtctaagtcagtttacgaatatgttcctaaagattctgaagtcgaaagtcgtttcgctcaagaactcgaagaacaggatgaagttaagctttatctgaagcttcccggctggtttaaaatcccgacaccattagggacttataatcctgactgggccttagttattgaagacaatggtgaagaacatatttactttgttgtagagacaaaaagtaaacacattggtcttggtcatgaagaagatgcgaagatagcctgtggaactgcgcattttagtgccctaaaagaagaacagagtaatgcagcaaaatatgttagagctacagatcttacagaaataatgggtagcctctaaactatataaaatggcctttcaggaggccatttaaaaaatcataagaatatccgtgcttaatagattcagtgagttaatagaaatcttgtttatttaatttttattacatttgtttagtttttaatattattggcatatagcataaacagttatagtagctgtaatatttttagttgtatcacatcctgcataccaactgttatcaccattaggtctggagaccgttaaccaaacatatccttctgctgtattacattgaccgcctccacctacaactttttctgaaccagcgcaataagcaacagctccggggaaacgataagcagaggcatatgctgttcttattactggacttcctgttgatccgctccatactccattaacacaagaaataactttaccttctggtgttcttcctacaacaccatttggagaacatccccaccctatattggcttgtccatttatataaacaaattcaccagcgtttattcgaccattagcatctatattaccatttgaatgaatataattagagttaagatttcctgatgcccacacatattgagcattcacctgatgaccagcattgatatcattagaggcataaatattaccagaactattcatataagcatttacagttcctccagaacctgttcctactgttccagcagcatatacatcaagtgttcttaaaccaccaccccagccagatggcaactcatttggatcataccccattaaaccaagcctttgatctattttggtatttctattaacttgtaatactgttgtataatttccagcagatggtgaatataaagttaatggttttgccgttcctaaacgtatttcataatcatttccagcggcatctcctccaagcgtaatggtatcaccataaccattatgtgctataacttgagcggcagcagttacattgcctcctgaattaacattacttccaaaattacctgtacctgatgctgttatgtttttagcattatttatatcattattacccatatttaaattccctgtcatgggtaaagtaccatctctacgtagataagctgaatacaatgatgcattataccccgctctaaatactaattgtccagctttagttatattattaaatgaagtggactgctcactccagctaccattatatccgtcagcttttgtattggattttgtcataccactgtcaatacctgctgtttgcatggccttgcctaacaaatcaaaacgtgttttaccgccttctgaccacggatttgatgttgttattagaccattaataacatagttaggtgtagttccatcacgttttaatatgattttatacgaggatctattagcattagtgcctgtgaaggctgaaggtaataaaccttcgttaatcaatgtctggtaagtaatttcacatactgaacctgagcaggttcttggacccggatcggttcctgttccggcagcattggataaggttgataatttatcatagcggatatttatatatccattaactgcttcaccgatctgtttcatttgttgaccgacagcagaagccaatatactctcctgttcatttttcatatcctgaaacttcataaaagccaccatcgtcccaacacctaaaacaagagttaattctagtaaagagaatccttttttaattttcattttcatcgtcctattttatattcacgtattaattaattatcaaataacaaacaaaaatcaagatacagataaaaacaaatccccagccatattaaaattaagctagagatttgtcaggacgtgaaatataaacctaaaaattatattttattattttatagatgaaaaaatctgattatataagattatgaatcattatactgatagatatatcatcataaatagaatgtcaaatcttttaatgaaagttaacgataattatctattggaattttttctcaaataagtgtcaaatagtttatatgcattatcaagttttccttcctttcatgctcgccagaaataacattccgcttcttttaaatctttctttatcatctggatgtaggtggggtatctctagtagcatacctaaaacaagatccttatccaccgtaaaaacatcacaatcaagagccttggcaacttccgcacctaaaattattttctggcgtgtttctatctgtttagactctttcttagacttatgttgtaaacgatttaaacgcatctgagcagatgctaattgctgttccagtgtcttttttattcgtggtttctttctggtttgttctttatctgaaatatcactcattttctatcctcctatagttccatgatacatatatatttcttatatatatgttagtcaatgaggatatttgaaaaattggattattatttctttttatgcgatgggaacttttcttttaagatattaaaacagttaataacattttcatgttctactgaaaaataatctatgctccttttcagaagatcattggcaacatcaacaacaaattggctcccttcactatgatcatagacagtaaatacatcagctatccagtggtagcagcaaagcgtcaacaaaatacaatagtcttgatattctttaactcctgataaaaaagtatatccgttataatctacttgccttgttcttctataatattgtctaagcgtgggtttcattattattaaattgtttttaactatatcatagtgaatgtcatcctgaacgtagtcgtttttaagaaagaaactattgctatgaacatataaagcataggcaatggtttcagttgagactccatatttctcacacagagcctttgagacaacagaattgttttcaatatgtcttataaactcactttccttcaagttttttgttttcaattttttcatgtattacctcttataaaaaattataatatcatcattaatgaatgctttaacgacgaaatggcactggttttctccattcaaactctgcctcaaacctttctttatttctttcatttttgatctgacaagatatacgattgttgaggatcttttttcgagcaatttttaaaacttctttcatttcacattttacaagctttctacctttaattttcatttcttcatatatggcattattgataaaatctctttctttagctgatagtatctttaatcttccttgctcatccgcattatttgaaatggtattaattgtttcatcttctttttcttccatatcaactctactcttcttttgtttttttgatttttgctcttttctaatcgagcggacttgatcacgagcaataaatttgacagtttgtttttcttttttatttagtgctttaccttttaacttagcggcttcttccagaaaatcatctattatctttttttcattctcagtaagattttgtatccatcccattcttagtttttttgttttactttccatatcattacctttttatttagattttttaattaatacaattaaaaaacaaaaaactcaaattaatccatgcaccatatttaatttataagcctacttatctttcgttagtgccttgatgaaatggcacctacctactgatatttttaaaattatttttttgtactagtagtactagaattttattagattaggttctggggttttagatagcgactttcagtcgtagtagttttccgtcaggaaaacttagtttttctgcaagcttcacccccctaaccccccgtaaaaaaatactattgtaatattttttttaggttcgcaggttggcgattctcaccgtagctattgagttccagcacgtttccattactgggacaccccatcggactcctacggatacatcatgatcatttaaagcattttctcgttttactaaagaaaattatactaccgctttatagattttagatgaacgcttcaagttggtggctaccgacttccccccgtttatatgccacctacaataacctaagaacaaaacagtttttaacacatgatgtccaaagattcttagacctgatacacaggtttaacgttattgcttttgaagactaaaatgtttttagaaatggtatttgaaaggcttgtaaaaaagttgcgatttagatttgacaaatatgaaaagattatttaatactttattatatttgtaatcacgttgtctcttaactgattacaaggcttcaaaagtcggcaaaacttttttagtccttaaaaagtcaactttgaaagttggctttttttgtatctttattttatttacaacacaatattttacttgtcaaataaaacaacctaactttattaaaaaataaaaaagaccagataaacatatagtctttttctctctgttatatttcaccatactactttaaaacgttctgtatgcgattttaagaggatatttttatagctttagtatttatatcatttttattcatgtgcttcccataaatgatctacgcttgaaatatactcatccaccgatttattataaacaacatcgtctctgcaaattagagacgttaaaaaattatcagccctaccttcctcaaggtatataaacgatattaaatagtagaaacttctgtgttctttaccaatatcatcaaatgaaaaaccatttaacgttgacatataatagaagtatcttgctaaaacttcaaacttaaaatcttttgacatgttttttaaaagtctttcagacattattaacccctccatgaaatggacctgtatttcatgtgttttattatttttattcataagtatccttttcacatgtaataacctgactgaatccccgataaaactccattcaggaacaccaatctatcttcaagcgtagttttataatcatcaagatcattcaaatcttcttcaaaattgaaacaaacatcatagttcaccattgagcataactcttcttcgatatcttctatttcatcctcgattgtttttatatctaccatttgaaaccatccttatctgtttttaaggagttaatacaacattaaacataccacgtcaaaattaacattgaaaataaatcactgtattttttatttgatttttatcatttaataagcaataaattaaatctagaaattaaagaggttgtgaatgaaagagaagatcataaaaatatcatggggtaaaacctcagatgggaaagttatcaatgtgaatgatgctataagagataaagattattattgcccgtgctgtgatgaaaagttaacattgagaacaggaaatataaaaagaaaacacttttcacacaggaatgattctaaatgcgatccagaatctgtctatcataaactggctaagtttcttatttgttatgctatatctgaaaacgcaaaaggtaataaacaaataaaaatggtcagtaaatgtcatggttgtgataaagaacataaaaaaataataacgcctcgtattttctcaaatgctaaagatgaggttcctatcgataaatatcgttgtgatgttgtcgcttacctgaacaatggtaataaagtagcaattgaggttttccatactcatgaaatagatgaggaaaaaaagaaaaacctatcaataccgtggattgagttaaaatcagaaacagtaattgaagatccttttttgtggatttgtgatgactttaaatttaaattaagtttttgtagtgattgcataaaacacttcaaaaaaatcatttctgtatgtgataagtacaaaatagacagaaaactctatacaccattaaacatacctaatgataaagactataattacattgctgacgtaattacatgttatcgttgtaaagctatcacgccagtattctttcataataatggaaccgaatatgatgccccacatacattaaaatttatcaagacacctaaagttccaaaaggctatctcactaatacttgcgccaaatgcggaacaataataggcatgagatatgctttttgggaaacatcacatataaaaaaacttcaagatctagaaatctttagagacctagagttagaacacttattctacgagaaacaacagtggtttggaaatataagttctaagcaaaaagagttaaacctgataagatgtaaattaatggagaattgaaaagctactgtactaccacgttcaggcagcacttcgtgattatttccgataatcactgagctgataacaggctcgtcctgttatagattggatttatccaaaaatggtgtttacaagaatctgcacaaaaatgcaacaccctctacaggtaattgtgcaacacatacgtgtgcaaacactaactttaaatgtctaatactcatcgcgttacttattttctctcattcatgattttaaaatcacttcttaatttctgacaagaaattcacacattaatctaatctaagttatcttttatcatatttttataaattttatctttcccgcctacggcgggagactaatttaactacttttgcccttacgggcgctctctaaaaccacaatcattaagattcgtgtaatacctcagccgttcatccgattctagccctgtaaatttcacagacagtaaaactagagttattatttagttataggaaaactttaaacattgtcgttatttttagctccgttaggagatataaaaataaagcaatgcccacctatacactgctacgcagtgcgtggggtctaccgacggttgcctgccgcaggctaaaagcaaggtcaacgtcaacaccagagtttttcttgcgaaaaactaaaaccagcatagtcgcattggagatttatattttagtttgatatttaaatttatattgaggttgtttttattgtatggctatttttcatcttgattttaaaattgtgaaacgttcagaaggtaggtcttccgttgcgaaggctgcctatcatgctcgtacacgtataacagatgaaagaacaggtgatacgtatgattatagccgccgtaccgatttatatgggcatttcatattagctccagttaatgcaccggaacatatcataaaagactctacagcattgtggaatgaagttgaacgggtcgagcgtcagcaaaatggtcaaacatctcgttatttcgatgttgctattcccaccgagttaaacaatgacgacaagaaaaaacttgtccttgagtattgtcagaaaaatttcgttgataaaggcatgattgccgatatcgcttttcatgatcttgatagcgataacccacacgctcacgttatgttgacattaaaaaccataggccctgaaggttttggtaaaaaagaaagaagctggaatgacagaaaaatgtctgtcctttggcgtgaatcatgggcatctatggctaacagctaccttgctgctgctggttcgtcagaacgtattgatcatcgttcccttcaggcccagcatgaagaggcattagaaaaagcggcggttgctctggataatgaagaaaaagcactatggcttgctaaagccgcagaaacaaaccgccctgcaatgaaacgtatccacagtgccaaatggcgtagtaaggctgctcaggagcaaagggccgcagaacaggctgttcgtgatgcagctaaacaggaagctgttgaagtctataagacattcagtgaacttgaccttgaaattgttcttgatgtcagaagctttacgattacacatcttgctgaaccagaagaggtcattcttctcgactccccaaaagcagaaaaacaacaaccggctcttggagcacctgaaccatacagaaggccagtcgtaaaatcttaccgcgatccaaacaaatccagtaaggttggtatggctgaagaagaaactcctgttctaattgctcctgagccaaaaaaatccactaaactgaaaatcccttattctcaacataccagagcgagtaaacgcgctcctgttaaaagtaagaggaagcaggttaaatcccatcatcgtggcatatttaggcgtttaaccacctatatcgtcgattttttcaaagagaaatttatctgggccaagaaggaacctgtccctattcccgttgatgctgaacacgataagtgtattgctgaaaactatgtctttgatgaagtgctgggtgtctatattccacgctctacacatgaaagacgagtcagatttaacagtgatgactacagaccaacacctgatgaggtcagacgttttccacgtcgtccggttagcccaaaacagtctgataggaaactagactatataccaacactagtagcagacagaaaaaagccaatacctaaattgaaaccaccgggttattataacgattaaacatacaaaatgatcagcaaaactcaacaataacacaaattataaattattttatttagatgaaggtattagtctgcccccatcgaattcatctatgtaagatgaaggatgacaatcaatgacatctattttaaaaccatttattcagccattatttattcgtgcattagctaaatcacagagatatttgtttttatatcccccatgttccaagtccatatatgcagggcaattcctacatgcagcgtttaaaacacattgaccacacttactatcataatatattttatggaaatgttcactgatagagtttagctctgcccatacatcattaatgtttccgtcaataatattatattgcttctttctgtatacagcacaaatagatgcgcgaccaaactgatcaacaaacaaactcgaataaccccctgagcatttcttaaaatagtctaaattatccattggtatattaccatctttaattttccgttccattgcaagatcattttcaatcttaacaatttcattcggttccaacctctcttctaaattattttgatagtttaatgatggaataaggtatgtgtttatctcaattttgttttccgaaaagaaagctagatctgatgaagatacagatattgatttacatagggttaaacctttgtatattgtaatgcctaactgttctaatctggatatattcgacattatcctatgaaggctggctcttttatttttagaaaagctacgaagctctctattatctttgccatatatagagacagaaacagaacttggtgggtattttccgaatagttcaaaatgtttttcagtcattaaactcgcattagtaaagagtgaaatatcgattccctgctgatgaatgaatgtatataatgaaatgaagtctttataaagaagaggctcacctccagtaataattaatttcctgcatccttttagcattaatttagttatcacgtttttccattcgttcacatttaatcctaatgaggttttattatcaagataacaatgcggacatttaaaattacatgatgttataatttcaatggtagcagatgttaaatctttcattatacctccgtaaacgcagaaattctgcgttgtgctaactcgcacataaaatctatcggttctgatgaatttccatgttccaaattggcatatgccgcacaccatctgcaaatggatttttgatcacatgtagagcatttgctattgatataataactttgcattttattatgtgaatctttcaagtatttccttatggttttctcatcattactcaaaaaactaattttatcttccacatataaagaacatatagatgcatatcctccagcatctattgaaaggctattaatgccaccaccacatttaatacatgcttgtgaagtcatattagatattgatttcctccagaaacttacagtttctggattactatgctcaaagttaataatatcatcaatactagctctttgagatagtttacctctcattaaatctttttgtgggaaaattatggcatcatacataatttcttttttataaactctagcaatatcatcaaactttccttccaaagctgctggtatggtttcttttcctataattgctttcaacatgaaatcaatattattagaatataaaaactttatattttcgatcactcttttaaaagcacttttatttatagtgaactttgcgtattcgtcagcaccagtaccatataacgtaatcatgataactttgggtgggtatttgataagaatttttttagtcacatccgttatgtaagataaatttgacataatcgagatgataaatcctttattttttgcatatgtatatatctcatcaaatcttttatataaaaaagcctcaccaccagtaaatgtaaggtacaaaactcccatgctgtataatttatcgatacatgcaataacatcattataatccatatgaacttttttcgttggacaataacaatggagacatttaaaattacaatactgagttaactcaatactggcggttattaaatgttctctttgaaatgctttttctttcaaggagtcatgattcatttagcttaccatatattttatctaatacgttttggatttgaatgtcatcaaatccatatttcttttccaacttattgttttttatttcagttgaatacattaaaacatcaaatactagttcgttaacattatagcacttattattagattgattgatgacaatatattcatccattatttttcttggtatatatatgcttttcatcttaatttataactatccaatataatataagagcaataaccacattgctcttatttgagttattttattttaacattggttatacccatcatctgggctaggcccccaacatccaagagtctttcttttggatacaggatcaatatcctttacttcctcaaactcacagatatcaatctcgtagttgtctacagtttgttgctcgttaacattcatcttacttcctctctacatgatacattctttaaatatatatctcttgcatgagaacacattgacattaatcaaaaaacaatgattctagaggaagtagacacacttactataaaaaattcaattcagccaatgacaaaataaacacaatctcatgacgcacatcacaaaaataaacttaagctctatgtaaaaatgccgtataaaataactacacaactttttcaaaacacattaaatagaaattaacaaatcatacttagtaataaattttcatccattttaaacaatataatagaaaagctctccccgtgccatttaccgaccttaggtcggttttttccttctcataatgctaaagttgagcatcgcacatacttttttttctgaatcaggatagacaggccgaaggtcaataatataaccacgaaagcataccagccggggaatgctccatctaaaacctcaaacaaggcatccggaagcgccccttacagtgaaagaaagcataaggccactccacgtcagggtaatatctttaaacgttttacagctcttatggtttattttatcagatataaattcatatagcccaaatgaaattaaaaagagctatgataaaacatagctcttttcactttaacttctacatccttctcctgaacacaacattatcagagaagatcgccttacctgcgacaaacccaacagccgcaattatcggtaggctgatagtagctcccgccatacctgtagacattccgatcagaatagacaggccgaaggtcaatactataacaatgaaagcataccagccggggaaggttccatacagaaccgtcgccatgcagccagtacaaacatgcacaccgcgctggctctctttcaggcaaaacggacactggattgtattgttttccatgatagaccccttagagcgctttccagccattgcttgttttaactaaattaattgcgccatcttcaggttcattcatacccttgacgtttgcgaatgcttttttatccacccatgaaggaacatccgccaacttccatgtataactaacatgaacaacctgctgattaccgttgcccggctcagtccattccttcacttcatcaacttcacgatgaccaatacacgcaccttctgcccggttccaaaactcaacattttgccctttgtctgttacttccagaacatcgacactgctaaagccatttgcctgttgtgaaacagtgagcaacccttgttcagcaagtcctttaaggatttcatcactaacattgtatcctgcagaacggtagccatgattaacctttataggaaaacctttattgaatgcaaagtcattgttctgcagtgagtagcacagctttgattgtgaaattttcgcgttgatcgctttctcaaaatcgcctttttcaccgcagcctgatagcaacacagcaaggccagcaatggctaaaaattgacgcatggttctcatcccttttaatgattgatagtgccgtttctcagaacaaccagacgaactggcatatcggcattgtttactgtggcaaatccacgaacttcgaaattgtttaccgttccagtaacgctgactttctggcctttcttgtaagtaagaacggcatcatcaataccagagtagtaatccagccaaaccataccgccgcagtagcttgtatcggcagttttaaagagcaggtaatagtggggggctgatttgggcatacccgtcatcatatcgcttgcacttctgcccttagtaacttccagaactgtggcattgctgatagagatccttttgcctgtccatttcttttctgctgccattgcgttttcttcatagtctttgcagacagcacccagacctgatactggtgatgctggaccaagattttgagtggcggtacttccattcagcgctttacctactgaagacaaagaagagctgattgccccattgactttactcacgccatcattgagctgttggcatcctgttaaggccattgcagccacaagtaagattctcttcatttcatttcccataggtcaatacataacaaaatggcttgaactggtatgggtcgtgtgaacttctctatctatcacttttgatagcattgaggtcacctgtatcggcaaaccagtacatcatcccaaacagatactacgttaaacgtagtattcaagacaaggtaaaactacgattctcgtagctcttgatgatgagggcttttatgaaccagcgagaatcccatagagaaatcttttgtaagcgtttgaaagaagcgcgtacggctgctggtttgtctcaaaagaagctgggcattgctgccgggatcgacgaatttgtagcaagcactcgtatcaaccgatacgaaaaaggagttcatgaagcggatattcatactgcacaaaaattagcagaaacgttaaatgtgcctttagcatatttctacgtggaagatgatgaacttgctactatcgtgatgaattatgaaaatttatctgaagacaataaaaaaacaataataaaaattattgataaaaataatattacgaagtaaacatatgtggttttcattagcatctactagttagtaaattttaactataccaatttacttccagtttttttgttaaagcaatcaaattattttatattcttccaataatataacaatgtgtttttaaaatcttttttgaggatttttatctcggtgcttacgcacggctacgccctaacactgaaccaatcatcaagtttttatgtataatttaaatcgtaaatttaaagtattcatgaacgttagatccttttttcttataataattaataacgatcgtgttttgaaagttagcatgttattttcaacctatagcatttgctcttaaacatatagggaaactatattcatagaagcagcacttcgtgattgtttcgaaacaatcacattgctggacagtgctttgcactgttaatgatggatttatccatgaagaattgcggcgatagccgctatgaggtaaatgggaaaaaatttcaactttaataagatatcagcagcgcttagtgattgtttgaaacaatcacttcgctgagatataaattgaagagagaaaaccaatgcaataaaaagtaaaactatacccctaaaatgcctctgcatagttgttctcagcttcactaattgaataatgaagaaggaaaatgctctcaggccagttatagcttaaaaccaagtaccgacatccgggagttaaagtcccgaatcccggtacttaagttgataactattctcaaataaaaatgataaagtattatttatatatatgctgtcgcactacaagtttcataagtaaaaacattaagtgttatttattttaaaaaatataaaccttaagtgttgacttacacgcaaaatatagtattaacttaaatgtataactaaaaaaataaaggagtaaataccatgatagaaaataagatacaaactgaagtaaagaaatcacgaagaggtctcccacgtcatactaaaaacccatttcttaatgatacaaatctacatacaaaaactggtattagacgtattacaacaggaaaagaccgcttagcattagtgaatgaaaatacgggagagcacgttggcaatggtggcttctttcaggctatggaagtagataagacacagtttgttaaactttatgttgatggcgtatcggctattgaaggattgtcttcatctggtaagaaagtcttcaagattctttatcttgctatcagagataataaggatactgatactattttaatgtcatatgatattgtagatcaagatatcgtgaagatatcgagaacgacctatttcaagggcatgaaagaacttgctgataagaaatttatcgcagagactatggtacagaactattactttattaatccagactatatgtttaatggtgatcgcttgacgtttatgaaaacatattatctttccagcagtaactctaataaacccagtaacaataaggtgaaaaaatgaaaaaactacccggttcacttgaaataaaacttcatgaaagactctcaaaaaatgatattctcaatgtactagcagaacaaatgacgatgcttgaagaaacatttggagttgaagaatttaaactctactcatttcttgaatgttatatcgattcgaaaaaacaagctctctacgaccatgtaggaaacggaattgtatcttcattgaatttagatagccaagataatattgaaaacacatcaaaattggtaagaaaagaaaatgacagaaggattgtttcatttgataaaaaattacatatagaaaaaatagaaaaaacggtaaaaaatctacaagctaataataaatattcccattgtgctttaacgacatctgttgttcctgcttcaagtataaatgctattattcacagcgaaaatattaaactgcaagaagaaaaacataaatcctatttgattaaaaaacaaagagagagagaagaggaagaacgtagagctaaagaaaaagaactttatgaacgaccactgaaagaatttatcaataaaaagataagagaaagtggattatccgaaatggattttaaaagaacaataagttcaagttgtgattatctgtttagtgtttccaccaaagctaaatacttcgctgagaaacctgaactttttgaaaagtatcgtgatgagagattaatccgcttttcaattaaaagaccagatggaaaagttggtaaagttgaaatctatactgaaaacggtgaacttatatttgaacaatataaaacccttaaactagtttaaaattggagattgttatgcaatgtgcttgtggtggcgaaacaaaagatagtatgtcaataagtaaattacatgacctcagatgggaatttgtgatctgtaaatcatgtgggagaatagatatggatatattatttgattattccagaacaaagataatacttaaaggttatcaggcaaggttgttttatagagagcagacaataaatagtaaaaattcaaatgaggatgaagaatgaatgatactgttattaagataccttgggctaaatctgttgatgaaaaactcattcatattcacgatgcagttaaaggccaaaaatattattgtccgtgttgcaatgagcaattaacgtttaaggaagggaaaatcaaaaaaagacacttttcacacagaagtgacacacaatgtgatcctgagtctgtatatcacaaactagcaaaaatactcatctgttatgctgtatatgaaaatgctagaggaaatagaaaaatcacactaatcagtaaatgttttggttgtcatggtgaaaatattaaaactatcccaccacatttcttttcttcctcacacgaagaagtctctatagataactatcgctgtgatgttgtcgctgacactcaaaacagtagaaaaattgcaattgaaatttatcatacccatgagactgatgaaaataaaaaagaaaaactgtctattccttggattgagctaaaatcagaaacagtcattgaaaacccatttttgtggcgatgccatgatttccggtttcgcttaggtttttgtaaggattgtataaatcattttatggatgttatcagattatgcgataaacataaaatagatagaaacctctatactccattaaacataccgaatgacaaaaagcacaattatattgctgatataattacttgctaccgttgtaaaaaaaacacacctgtattcatccataacaatggtcctactgataaagctcctcatacaatttgttttgtcagaacacctaaagtaaagaagggttatctttccaatacctgtgtccattgtgaagcaatcatagggatacgatatattaattgggaaacaacacatattaaataccttaatgattttgaatacaccctagaatataaatggtttggttccaaattaagtaagcaaaaagagcttgatatattaagaggaaaattaatgaatataagccataaataaaattgattattctcaagaagatgagtttgatgaagtagaaaacatataaaacttttgcctatatattaggtcatttgacacttacaccatatctcgtaatataaatatatacattattttattaacgaggttttatatgagaaaagtaaaaacagacaacagtgatttaatccaatatttagatacagtaaaagaactaaaaaattatattccgatagaagaataccgaaatgaatatcgtaaactatgctctgataatattccgtggattaagattaaaaaatttaagtctgcccataccgaacttcgcagactggataaaaagagagaatctcttattgaattgtttattgatgaacttaacccgataagcagttcaacagcacgaacagcagcaaaatcatcaggtaattttgatgtactgcatgagagaatgctttattccaaaacactttcagaaaaaagtgatgaagaaattgttgccttggtcgtaaaacagcgtaaagaagccgctctggagtttcagcgttctattgaacagagccttgaacaactctcccgcatttcgtcagagttcaaaccatcaagtcagatacgcaggaaaatgcctctgtaaaacttatcctgtgctattcagtgtaaaatggaatttattagattgattaaccgatagtatttactatattatttatcggttagtatatttttggctgttcaatcgcatcctatacattaactgtataaatccccattttaaacacaggaaggcatcgtatgagtgaaactctcaaggcactgaataatattcgtacacttcgcgcacaggctcgtgaaactgatctggaaacgctggaagagatgctggaaaaactctctgttatcgttgatgagcgccgtgaggaagaacaggcaatactcaaggaacaagaacaacgtcaggctaagcttgaagccttccgccagaaactgttagaagatggtatcgatcctgctgaactacttttagcggttggttcatctcagcctaaagcaaaatcaccccgtgctccacgcccggctaaatacaaatatacagatgaaaacggtaatgaacagacttggacgggtcagggccgtactcctaaagtgatcgctgctgctattgaagcaggtaaaacactggaagacttcgcaatctgatcattctaaggccgtcaatttattttgacggttttaaaaatcaggctatatgtaatactggaatccattccgtcattacactattgatatactcatacattcctctaaataacattttcctgatgttatctatttatgtccagatcccagtcgagcactccattatcaactaaggattgtcctttttccagatttcttatcaacatatccctgatataaaggtcataataaaatgttactctctccaatagctctgccatatctatatgctcctttttttctttacccgaaccataaagacctttgtaataatcgaaaccattaatgatttctaacatttgagtacgtaacagtgaatcaacagcatcctcttcttttacaaaagtcataacatcttcatcatttacacttgccatcccgtaaatcctgtttacgtataacattaatgtcactgatatagcaaatatcatcgttttatcttttttgctcatcttaactttttccataaaaatcctctcttattaatattaagacttaaataaaaatacacatgagttttagcaaaacacccaagcattacgcacaagccgttctgcaacctcttcaaagttgacctctgtaaggtgtccttgatttccttcttgtgtagtaaacttctcaaagttatgacaaatatgattaatagtgagccgtataaatgcgctcataaaatcagcatcatcgacaagatgcgaaatgctatcactacacatatcctgcattgttttccagctcgcttcaaaagaacgctttgcaagatcatagaacaactcagtagatgtatttttactttcaatatttttagtcatgattactcctcatttttacatgatatattttaacttactcttattttcagcccctgaatacggggctaaaacaaaaaactacttttgaaaatctttcataaaatccatttgtttatgaaatgcctttaatgctttcaatataaaatcgttatcaatgagccttggtgataactttacatcaaagaatgtattccttacgactttagggaacatctgttttgctactttaatactgtccttataagtattcatcataaaagcttcttcatgcttgagttgttctacttgttcaggatggttctgaataatagaactcacacgcaattcaaagcattgtttagataaatgcagtaatatcttgtttgcttcttttttcagatctttattcatgatttcttcctctttatttaatgccaagtttaggatagatttttttgaactctctataagagtattttaaatcttccataacttcatcaatcaaaaaaacacattccccaacattattgtctctcacccacttgaggaagtctggttttgtgatataaataatatgatccataaccatattcatatatttttcatcataaagatgacgttcaaattgatcacccattatcttaaacatgttttccacataaagagctaagttatccattgccattcttgagaaaacttcagttttatcattatcaaagataaatgatatttcagacacatttatatttttcatgttattttccttttattagttagatgtattacgagaagcagttatagctttataaatccactcatcaacttcgctttcaatgaaagcaacagctctgtcaccgatttttatttgtttggggaatttccccgcgctgataagtttataaatccacgttttgccgaacccggttttccttattacttctgataagcgaataagttttaaagttttatctgttttgttttgaaccatgtttatctcctgtgttgttcgatggagataattctaggattttagctggttctaaactagggatgttcaccaaccgtgagtttcgcggaaatttttggagggatactctttatagggacattcgcagcttgtgaacatcccttgtgtttactttttgtttttatccgtggctttatcgttaaatgttatcacgtcagtgatcttccagtcctttaacatattgtttttaatataaaaatcatttaaaaccttgaagtactcatcgttatcaagataacttttcgcgtaatcataatcagtatctttgatgttatcacggctccgaatcccaccagtaccatgtagaatgtcagctaagatgttgaaaggtatgttcttaccttcgttgtagagctgttcccatgagatcaaatccatcaaagggatgactttgtaatcaagtattctttgaaaagtcttatgaccaaaccgaaaagttcgttttggtggttttgccgttttaagctgcttttgccatagagcaatcagcaccttcaggtgttctgcgagatcgtcgctgctggcttcttccaagtcaatttcaaccagtattttgttggcaggattcatgccaccttgtttcagatactcagagatgtagtcagaactcactgcaacagggtctgtttgctcagaattctccagccgatacatagcccgcccatagttgaacaattgaactctgctcattggtcttacagcatagctatgtgacagtctgtgattgcctgaaatccagtctgattgaagtatcacatcaccacatcggattttggcatcatggtatatagcttgcatttgattatctttgcctgctgtttcccattgttgccttgttttgtaagccaacatccgtctttcaagctctgcatagatttgttctagggtgaggtctttcaggccatcatatcggcgtacatcaaaccaagataatgcagtcctgatttcttccatttccttttgtgtagtcattattctaccgattgcttttaagtttcataaaagttaacccattcatcatgatagagaaagtggaaaagaggggcgggttttcaaaatggtgtgagagcagataagtgatcttggatgtaagtgctttaatcttgactaaacatcgtttctttactaaaaattaactaattgttttatatcaattactttaacaaaaataacgacaacatcatgttgatagataaagttaaatcagattcgtatagttagatggttatgacaacaaccaattgtttttaattgacattttattgataagaaaacaataatgatggtaaatatgttggtaaaaatatagttaaacttaacaaaatcagtaacaacaggagatacagatgaagttcgagtccagtcagaggagccaaattcctgaaaagcccgcttttatagcgggatttttgctatatctgataatcaatttcctcttcactgctttccatcacctgccgcttgatatcctcaactaacagtcctgcattacaaagttccagaaagcgccagacatagttacgctgaagttgtcctcgcttcagtcccaaccagacagtattagcatcaaaaagatgccgcgtatccaggcggattaaattctcttcctcttgttcgccactggattgctcggcaactaatccgatcccaagcccaagagcaacataggttttaatgacatcagaatcctgcgcacttaatacaatatctgccagcaaacctttgcgggcaaatgcgtcatcaatacgtgagcgccccgtaatcccctgtcggtaagtgattaacggccacttcgctattgattccagcgtcaatggtgaaatttgcgtcaagggatgatcgtgtggaacaagcaaactatggtgccaacgaaaccacgggaaggcgacgagctgcgggtcattactcaaacgctcgctggcgataccaatatcagcttcgccattttgcaacaatgtcgcaatttcctgtggcgtcccctggattagctcgagccgaacctccgggaaaagttcgcgaaaagctttaatgacctctggcaagctataacgtgcctgagtatgcgtcgttgcaatagtgagaacgccagacgtatcgttggtaaacaggtctgcaagccgacgaacattactggcttcattcagaatacgttctgcaatgaccagtaatgctttgcccggttcagtcatgcccagcagtcgcttacctcgtcgaacaaatatttcgatgccaagttcatcctccagttcccgaatatgacggctgacgcctgactgtgaggtaaaaagcatattcgcaacctctgtcaggttgtaatcctgacgtgcagcctcgcggattatctttagttgttggaaattcacggtaaactccgggcagttcagatttcccgttattgttaaagtctaatgcccggcataacaaataataaaaacccgcatcttattccatcccgatataacacttagctcaccaattgccactgccttttttccatcactggagaactaatcactgacattaacaactctttcactgcctgtgcctgtggcgataagttcgctctggcgggtaaatttaatgacaaagagagactcatggaaggagtggtaatgcgtgacatccacccatttactgcgccacataacgaacgcgcggccgattcgggtaatactgcaacgcccatgccgctggcaatcgctgcggtaagcgtggcaatagactcaatttcaccaataacttttgccgtgagtcgccgtagggaaaaagcctcatcaacacgaagtctaatagcactgtaatcactggggagaaagaggttcatttgcgcaatagcattcacatcaacgctttgccccgggcaatcttgagttcctaccagaaaaagatcttctttcagcaaagcctgactggatacaccagccacaggggaatgctcataaatcaccgccatatcgagttggtgatttatcaatttttcgttaagcactgcaccactattttcatgaagatagataacgatctccggaaattcagcgcgaaccgcctgtaataagggcatggtgatggatgacgcagcggttcctggtgcaaagccaatcgagacttgccccgataatgcctgaccaacgttatgcaccgccagttgggcctgttcacactgacgtaaaatggcccgcgcatgggtatagagaatttttccggcgtctgttggtgtaacgccccgctttgtacggatcaaaagttgttgatttaactcaccttccagtgtggcaacctgctggctgagcgctggttgtgcgatatgcaatacttcagcagcctgggtcaggctaccaatatctacaatttttacgaagtatttcaggcgtctgaagttcatgttgcctccggtttttaagaatcggcccaagtgccgccattacttacaaccagattgcaagatgcttgccagttttattttggtgttgatgtacaagctaaccaactgtcaaataagagattatgatagattcgtcatttgctcctttaatcagctgtcgcgttcccctgccctataaaaggagggtatgcaccacgatggttcattacccaataagattgaaagctcaccactttgttgaaattgacagcaaacaaacaaaaaaatgcatttcaccctttgacatcaccatgcactgccattaatatgcgcctcgttcacacgattcctctgtagttcagtcggtagaacggcggactgttaatccgtatgccactggttcgagtccagtcagaggagccaaattcaaaaaagcctgctttctagcaggctttttgctttctaattaccaacgctcttaaaacatctgtcttgaaccagaactaatttgcacaggcattcccgatcgacgttgcaacgcagcatttgcgcgatttacatcaacttcttgcccgttgataaacgcccgcaaagatggggttaccggcaatggcacttttcggtcagactcatattctgcacgattgcgcgacaacggctcatgaacttccagccagttcgagccatctggttcagtggtgtattttactggctggtcgataatttgcacacgcgtcccaacaggaacattatcaaacagatatttgatatcgtcattgcgcagacgaatacagccctgacttacccggagcccaataccaaaattggcattggtaccatggatggcatacaacctgccaatataaatcgcgtacagccccatgggattatcggggcccgcaggaacaaatgcgggcaaactctcccctcgtttcgcatattcgcgccgagtgttcggcgttggcgtccaggttggagcttcttgtttacgttcaacggtagtcacccagttacgcggggtttctcgcccagcctggccgataccaataggaaagacttccacagtattactgtctggtgggtagtaataaagacgcatctcagcgacgttaacaacaatccctttacgaacagtgtcgggcaaaatcagttgctgcggaatggtgagttgcgagccagacttcggcaaaaaaacatcagcgcccgggttcgcttccagcatgttacttaacccttgcccgtattgtgcggcaaaagtctccagcggctgggtattgtgatcaggaacagttacagtaaacgactgccccactaaacggctaccctctggaggtaatggataagttaccgccaggctagtatggctggcaaaaagcagagcaaatgagcaaagaatatttacacgacgcatcatgtccctttcctatgtcgcgaaagctatccgttaagtatagcttttatcagacttttcgtttttaactgttcaaatcagaagtcgtattccccggtagaacaatattactggcagcaagttcgcccatgttgttgtatatcgcacaggcagcttcgatgatgggcatcgccagagctgcgccactcccctcacctaaacgcatctccatattgagataaggctccagccccaaatgcgagagcgctatacgcgcgcctttttctgccgacaggtgagaaggaatgagatacggtttgatcgcaggagacatctggcaggctgcgagcgcagcagcataagaaagaaatccatccagcaacacgggtaaaccgcaggaagcagcacctaacatcactccagctattccgaccaaatcaaatccacccacttttgccaggacatcaacaccatcctgaggatttggttgattcaacgtaatcgcccgacgcacaacatcaattttattagccagtttatctgtcggcaggtttgcgccaatcccaaccacttcttcaggatcccggccagtgattgtgctgactattgctgctgccggtgtcgtgtttgccatccccagttcacctacaccaaacagcgtgacaccgttttttgccagctcctgcgtataacatatgacgtccaaaagcaacttttcagcctgacggcgactcattgccggagctgaagcaatattgccgctacctcgtgcgacacgcatgttgataagcccggggataggctcagcagtatcaataccaacatcaattacgtggacgttagcgcccgcttgttctgccagcacacacacgccggttgttccacgggtcatattttcagcctgtatggctgtcacttcttttggagaaatagcgaccccttcctcccagacgccgtgatcggcacacataaccagtaccgcttttttgcccacatgcggtatgccattcaaccccggcattcctgccagttgtatggcaagcacctccagctttcccaggctaccaacaggtttgagtaacccgtcaatatgccgttgtgcacgcgacatagcggtagaatcgatggctgggatcgtattcagtaaatcggcaagtatttgcatctcacgtctctttatagcagtgccagcaggaagaccagttcaccaagctctatggctgctcccagcgtatcgcccgtttgcccgcccagcgtacgtttgagaagctgaccgaggatgaaaatcgccaccatcgtcaccaccatagcagccacaccatgcatacccggcaataatacggcagcaaaaatagcggctaagccgagtgtgacgcaggtttgtcgcccatcaattttgccaatgaacacattgccaagcccttcttcccgcgcataacgatgacgatacatcaataatgcggcagtcccgcggctgaccgcacatgctgccgccagcgatgcaaggatcgattcgccacgcagagccaactcgcttaacaccagaatctttgccagtaccacaaaaatcaatgccagaccgccgtgggtgcctaaacggctatcacgcatgatttccaacatgcgatcgcggctacgtgcagaaaatacgccatcacaggtatcagcgaggccgtccagatggaatcccccggtcatcagcaccagcacaagtacgctaaacagtgccgccagtggtgcgccacaccatgcctgcagcaccatgaagaccagcccgctaatcgcgccaagcaataatccaatcaaaggaaaagtaataataccgcgagaataatgctcgaaatccagtccctgggaccagcgacgcggtacaggcagacgcgtaataaatgagagcatcgcccaaaataatttactcatttgatttttactccaatacccgaaaccaccagccatacttcatttgccgcagcggccaactgctgatttacccgcccggcaatatcacgaaaatgtcgtgccagacgactctccggcacaatccccattcccacttcgttagtcactaatacaacctttgcggggcaacgttggcaggcagcaatcaacgactgaatctcagcattaatcgcctgttccatcgcctgataatcccattcatcagggtctttatcgccgccataatcaaacaacagattagtcaccattgtggtaacgcattcaagcaacacaacctcattcgggttaatgtctgcatgaattaattcatcaagatgttgccagcgctccactgtgcgccagtgctccgggcggccttgccgatgatgttctatccgtgcagccatctcatcatcaaggatttgcgaggtagcgatatacagaacctgtgaagagtccccaataagcgcctctgcgtggcgactcttcccgctccgtgcgccccccgtcaccaaaatcatcataccgactcctgattcaaatgtatgatggtattcattgaacagaacaatggatcccccaccgttgctgaccgcaaaacatttacgcgattaatactgcgcgtaatataattaaaaatccagcattctcaatccattacgaaataagatggcattacggaatagccagactttctcgtgttaacgtccgacaaaatgcgtcattgacagcggtttctgtggattgacacatttcattcagataatgaattaatgctactgccggaacaaccagcaaacgggcattgtgttctgaaatccaggctattgattcaacgtcagcgacagatctgcgctgtaaaagaacttgtaaaacaacgtaatagaattatccggaatggtggcgactatgcactagaacaccacaatttcgctctctcggtaaggcactgtcacagcattcaacagaatgtgacttgccagatttattagcgccaccagatgtttaaccgggtaaccacgacccagtcggggatatattccatcttctcgctgacatcatcaagaataaaaaggtttatcacactcagagcaacgttcttcagcaggcgggataattcttcaacatttagaagatgtgttattaaaggcatacaaactggacgtattgtattttcttttggtggttgacctaaggtagcagtttatcctgatgcgctgagatttctgtaatatctacgtcaacattctcctcgaatagaaaatgcagccccggcaagtgattcacattttttaacaaaacgttgttagcgtgccattttcagaagctctccaagaaagcgaattcttttctcaaattctgcattctcagacacagctttctactccatggtaatggcccaaatacgaagttgctcaggatcattagtggtgctgagaagttaaataaccatgcggagtaccactcgtcatcacgtatttatatatcatgaagctattgttgtgttttgtacatcagtagatatattctgatatactccttttgctagacataacctttcacctgcttgcaaagcttctgtgttctgacattgccaaattgttgcaattctgtatccagccttctttcagtcatagcttcgggccgcgataagactcactgatctgaccctgattcctcttgcagactttatagaccaattaaaatgcagtttctgcaggtcaacgtctgaccatcattgtcatcactctggccattagagtaaccttctgcattcatccttttgtaaaaagtttatattagtatcagcaattaaccggacctgatactgatatgagtcttaccgcatatacggtcaatttcagcaattaattacattatccacgccaaagtatttgtcatcacaatgatggtaccttctttcagacaccattttttcaactccgttttccacggaccgcactcttatgtcaagagtgcggtccgtggatacaaccagagaccgactgacacgagtcagaggaaacgacggatatgttcagtcgtaaaatatctatcaaaaaacatgattaaggtcaaaaatgtttgatatttacaatttatgaagatgacaataattatagatatatgagaacataaatgaaaataattatcattacagcaatcatttgtactttgtattaatgagggatgaaatgttatataatataccttgtcgaatttatatcctttccactctgtcattatgcatttctgggatagtttctactgcaaccgcaacttcttcagaaacaaaaatcagcaacgaagagacgctcgtcgtgaccacgaatcgttcggcaagcaacctttgggaaagcccggcgactatacaggttattgaccaacaaacattgcagaactccaccaatgcctccatagccgataatttgcaggacatcctcggagtagagataacagacaactccttggcaggccgtaaacaaatccgcattcgtggcgaagcatcctcccgtgttttaattctcattgatggtcaggaggtaacttatcagcgcgccggagataattatggtgtgggactgttgatagatgagtctgcgctggagcgtgttgaggtagtgaaaggtccatattccgtactgtacggttcacaggcaattggcggtattgttaacttcatcaccaaaaagggtgaatctccggactccctatatcacttaaattgatacaactttttagagtagtcattagtgaacagataattgataactcagaaccagtaaaatgcaaaagacgcaccacgctgggaaaatcgctgctattcagcagagttttgtatcgagaatggtggccagccacttattgctctcgcgtaagcgggtatccccatcgtttaccagtccagatataggtcacgtcaccatacttgatttagctgtgtcacagctaagcgcccttcaagttcttaggatagctacaagttcatgactgccatgcctgtaccggagggtcaacggctgacagctgaccagcccctgttctttcatgagactgccagcaagcttgcgtcccatctggtagtctctccgggttgcaattgtggcgatgttccttgctccgccattaagctcaattacctgactacgtaatacagcccgtctaccgtctttttttcaggacggtttttccaatctctgtagctgcttcgatgaatcctgcacacatggcagagtgctatcaccagataatgcgctctgagcttctcgattatcgagaactgtttagggagtctgacatcaagagcgccgtagccttttctaatatttcattctctatttcaatacgttgccgctttttcctcagctcacgtatttcgatttgttctggtgtcatcagagaggcttttggtgttttgctctgatgctcattacgcagttgtttgacttatcttgtcattgtggaaagaccgacatccatagctttggatggtacctgccaccgtaaagttctggttaacaactagttgagtggattcgcgtttaaactctgcgctgaaatttccttttttcattggagcatctgtgttgttctaaggtgagcatattacctatgctcaggtggccaaattcagtatgccagaaccagaacatcttgtggtcaggcagaggaagagcaaactgttactggactcactgcatgcgtggatggtggagaaaaatgccacgctgtccaaaaatccagactgggagaatggttcagctgtgtactgaatcagtggggcgcactctgttattacagtgttgacggtcaggcggaggcagacataatgccgcggaaaaagccctttgtgccatctgtctcggaaataaaaactttatgttcttcgacggcgagcgcagtgcactgttgtatgggcttatcggcacttgccttctgaacgacattgatccggaagagtatctgcgccatatcctgagcgtactgccggaataaccttccaaccgtattgatgaactcctgccatggaacgtagttctcaccaataaataagcatcaatatgattctccattaacgcttaccttttctccggctatttttgattttttttgcttttccccgccactttatggtgattatcacatcaatatacatcgacagatattaacgtaactgaagtgaggtgaagcatgaaatttgaacgccatcatgaaatattgaaacgactcagtaaattcggttctgtaaaagtatccgatctgtccaatagcctcaatgtaacgaaagaaactattcgatcagatcttaatgaacttgccagacttggctatctgactcgatatcatggcggtgcttttatcgtcctagactcgcttgatactattgcgaaaaatgaaatcgcttatgcgcttgaaaattatgatacagcctagggaataaaaaaaggccactcaactatgaaaagtcaagtatgcgttattggttcgtttaatgttgatatcatcagttatttgccgaggcttcccactatcggagaatcgcttctggcaagtaattttatattttcaccggggggaaaaggttgtaaccaggcgctggcagcaagctttgccgatactgatgtttatttcataacaaaagtaggtacagatcactttagtgattatgcgatcaactttatgaattcgtctaagatttataaaagtataatttatcaaacgaaagaaacgcaaaccggaactgccacgatccttgttaatgaaggtactggcgataatgttattgcgatctatcccggtgccaacatgacaatgtcgtccgatgaaataactattcagaaagaagcgattattaattctgatgtcatacttctgcagctcgaaacaaattataccgctctgcaacaagcgatcacattggcgcaaaaaaacagtatcccggtcattattaacccggcaccctataatgatatcgtcaacgaacttattcaggatgttgattatatcacccccaatgaaacagaagctggtttactgtccggcatagacgtacacgatcttgaatcagctaaacgagctgcagaagctatccacaataaaggggtaaaaaacaccgttatcacgctcggtagcaagggctcgctcgcatttgatggcaaaaaattcattcattcgccagcgtttccagcggtcgttaaaaatacggcaggagccggggatgcttttaacggcgctctggcatcaggacttgcgaaaggaaaatcactggaatcagcactgtgttatgccagcgcctttgcatccctggcggtggagacaagcaatgcttccgacatgcctgaacatgaatctgtgatacatcgaattcagagtatacattatcagcaaactatttttacgcattaagaagggacagagaatgaataacaccaaaaaatcactaaaggtgctctttattggagaatcctggcatattcatatgattcattcaaaaggatatgacagttttacctcaagtaaatatgaagaaggtgcgacctggttactccaatgtctgaaaaatagtcaggtagatgtcacctatatgccggcacatacggtacaaattgccttccctgaagatgtggcacagttagaacaatatgatgccatcgttattagtgatattggtagtaatactttcctgctacaaaatgatactttttatcagcttcgcataaaaccaaacgctctcgaactgattaaagaatatgtgaataacggtggtgggttattgatgattggcggctatctctcattcatgggaattgaagcaaaagccaattataaaaatacagttctggctgatgtgctcccggttacgatgttagatggtgacgatcgtgtcgaaaaaccagagggtgttattgcacagccatcacaacctgaccatccggttattaaagggttctctgaatatccttttttcctaggttataaccgggcgatcgctaaagaaaatgctgaggtggtattaacaataaacaacgatccattactggtctttggtaactatcacaacgggaaaatagcctgctttatgagtgactgttcaccgcactggggtacacagcagtttatgtcctggccgttctataccgcgttgtgggtaaatatactgactcatattgcaagataataataataatggggtaacaccagttactccatttactataatagaaggattgatgtatgaaaaagaataagtactcaactcccttatgggtgcttgccacgattcttgcgggtatgctctcccctatgcaatcagcggtgaatggtcaattaggtcactggttacaggacggtaatgcatgcgcagttatctcctttgccagtggtttagtcgtgatgttttttattattatggcgcgaaaagaaatccggcaacaatttgcggcaattccttctctgattaaaaaccgaaaagttcctctctggaactggtttgccggtctctgtggagcgatggtggtattttctgaaggcgcatcagccagcgcactcggggtcgcaacgtttcagaccgcactgatctccgcgctattgctgtctggtttactttgcgatcgctttggtatcggtgtcgacgagaaaaaatactttaccccttatcgcatcatcggtgcattatttgcggttattgctacgatttttgttgtgtcaccgcagtggcattctacctctttcattttacttgccattcttccgttcttagctggtttgcttgcaggatggcagcccgctggaaatgcaaaagtagctgaagctacgggatccatgctggtttcaatcacctggaatttcatcgttggattttgtgttttaggcacagcgctagctattcgtgtcgcattagggcacgtcactgttcaattaccagatgtctggtggatgtatcttggcggcccgcttggactaatgtctatcggtttaatggccattttggtcaggggtctggggttactgatgctgggggttgcttcaacggcgggccagttactgggatcagtattgattgacgtattaattccatcgctgggcaataccgtttatctggtcacgatcatcggaacactgtttgcactggtcggtgcaattgttaccactattccggaatacagagcctcgaaaacaatgaagaaaatggaggtataatcatgaaagattatctacaaactgtgacgggccccgtcgcccgtgaagatatggggctaacacttcctcatgaacatctgttcaacgatctttcctctgttgtggatgctccttgctatcctttttcacaacagcttgttgataaaaaagtcacggcagaaatccagtgggcattaaaacacgatccttattgctgcgctgataatatggaccgcaaacctattgaagatgtgatcttcgaaattaataactttatctcgctcggtggtcgcaccattgttgatgccacagggtctgagtctatcggacgagatgcgcaggcattacgagaagtcgcattaaaaacaggtctgaatattgttgcttcctccggtccctacctggaaaaatttgaaagccagagaattcataaaacggttgatgaactagcgacaacgatcgataaagaattgaatcaagggattggcgatacggatattcgtgccggaatgatcggtgaaataggtgtctcaccgacatttaccgaagccgagcataacagcttgcgggctgcctcgctggcacagattaacaatcctcatgtggcgatgaatattcacatgccgggctggcttcgtcgcggtgatgaagtactcgacattgtgttagatgaaatgggcgtctcgccaaataaagtctctctcgcacactcggatccgtcaggaaaagacgtggcgtatcagcggaaaatgcttgataaaggtgtctggctggaattcgacatgattggcctagacattaccttcccgaaagagggaatagcgccaggggtgcaggagactgccgatgccgtcgctcatctcattgagttgggatacgccgatcagcttgttctcagccacgatgtcttccttaaacaaatgtgggctaaaaatggcggtaatggctggggatttgttccagatgtttttctggcctatctggcggagcgcggcgtcgataaaacgatcctcaaaaaactctgtatcgataatcccggacgattattgaccgcataaaaccattatcccccggcacattgcgccgggggatgtcaattaataccccgccgttaaatcatccaccaagcgcgagtcggatgcgccgtacaactcaccatccgacccaaccataatgctttgcgtgctgcccatcgcctcattcagcgccactttctgaccttttgcttccagcagcttgagcgtatccggactaaacccttttcaacacgcagctcgtccggcaaccactgatggtggaaacgaggcgcattggtcgcttcggcaacattcattccacaattgatgctgttcaccaccatttgcggcacggtagtgatgatccagctaccggtaacaaagtgagtacataaaggccatactgtcacgaacagtgcaaaagtggctcttcctcaacctaggtgaagattttcatgccagtggactcattaccctccgcctaagtagttcaagtccggctcgaccatacatctggcgtatcagcaccttcaggcgatttacatgaccttcgacaacaccagtactccagcgactgctgattgcctcacatatagccgcagcatcagcttccatccccgcagctacgcaccgaagttctgctgagccgctttcgtggacccgagtgaaccagctgcttagctgtgatttattttaggttttcagaatacggtagaactcgagtaccagttgctgcgctattttcaactccggttctttttcacacatcagactaataaatcggaaagcataattttcttcacccctgattattctccagggcatcaaccagcggcttacccgggacactgaaggaagtcttgcggcagtagtaaccggtgggatccagcctttatgccatttggcaacagcatccctgacgatggtttcactgcctgtaacccccctggccaccatttcccgccatatccggccggagttataattaccacattctcgttgctcttttaaccactccctccatgggtccagaagccctcgctttggaggcctagttgacatttcagggaatgttcctgaacccacccagcgactgactgtcactcgcgacaggcctgtaatacgggatatttccctgaaactacatcccttgttatgcagggccataacctctgtccaacgctgatgccgttttttgcggatgtgctgtttaaggcgttccagacgacggagcgatgctacaggcacagatatttctggctcaggtgatttcttcagtgataactctctgacaacaagacgtatcagaggcatatatctgtacatcattcgttcaggctcatcaccaatattttttagcaggtgccatcgatcggccacctgtctggcctgaggtgcaccttcacgtgctgctgtcgcatagactccactgcgatcacgcgagacaacctgtatttccggatattttctgaaccaggtcgccagcgtacgctgatcacggccgggaagcaggacgaggggacggtgagtatcaggattgactattaacataccgcagcagtggccccgatgccacgcccactcatcaataccgacatgaggcgcgcctgactgtttcgtctccggggtattgataagcctgcgaagaagagtatcagcactgcaacggagacccactgccgttgcagcccgttttccagcctcacctccagctattaatcccagttgacgttgttaattttgtaacgcctgtgaagactgctggtgtgaactggcgaagggagcaagcgactcggcaaaaattttacgtgaacaagccgggttacggcagtaccagtggcggacggaaaatacaagccatagcgtctgccctgagcagggtagatgctgtatccggcgccgacgacaactatgaacagagtcgctacgcttaaagcattcaggacattgtgctgttttgcgttttccgtggagatggagggttataccgtcagagctaataatttgtcgactgcatcgccatccgcaaggtaactgtagaagtgtcttaagagagtgcattgcgttgcccataacttaaaacagcttagatccttgttcgccagaaagtttcatccattttcttccacccaggttgcggaagaaccacttttcatccgtcgttgacagatgtgaagtatgcgggagaaaaagtgaatatctaactgtaataactcagaccggtacgagtactcgggacgtctacaatcattcagggcaaagtgctaaaatttctctatcccgggatgcccctaccaacgcagcactcccggagatatcattacagctctgcaactgatttccgcgactgaaccgctcagttcctatccttccagttgccctcctgccccccctccctgctgtataccccggtaccacaactcgggcagcacttttccccctcataattttcgtcacacatcacacaaaaccactttctcaccttcaccgtataatccggaaccgtcataccctgcagatgcaaacgacgggcctctttctctgccgggtcaagccaggtgcatcgcagcaggattttctcagcgacagtcatctggtcatgttcaaaccacggtggttgtccgtcattgccccgctgaagtgttaacgggcatccacaggacacacagcacaaaacgtcctggcggttgtgcttcgctgcttctttcgccgtaacaaaatggcctttgctgtcattcgccatataacagttcagaattcgcatatttcctcctgagttgtccggggaatactgaatcctccggtctggcagtgtgtgcagtaccgctccccataataatcgtggtgacattgtctgcagtgccagctggctttacgcaccacgggtaaggcatccggtacgaattgctgcagacgtttaatcaactgtatttctctgcgctccggcctgacataagggcactgttgaccgtgctctgtcagcctgtcgtcagtgtgttcaaaccagggaagttcagtgtcgtattgcggatggtatctgagtgcactgccacacaagtggcaggtgtagttagcataaggtgcggcctgtgcagtacgggcgcccgtcagacgtccgttgccatcaagagcgataaaggattttgcgtacatagtcatattcctcagccgccagacgacacgcaggcaacagccgtcccggtacgggcagcgtggtcagggtgtgaatggcggttcagttaaaatctggactggagtttgggtaaagcaggctggttgctgttacagcactgtggttgtcacacaatggaacactgacgtaaaaaacagtcagtgggcgagtggatacatcgttgccgccagacaacaacccatacttttggtttgccgggtattggcgcgccagtcgtgctcaactccggctacagccaaaattgcgctcaccggtgcagtgagctttggtatgttccttcgccagatagtcagcacgttccagcacctgctgaaagccagtgtcatcatcgcgttccagccacaccgccggccaggccggaaaatgcaccagcgtggcatggcacccgacatccactcccagggcactgcaccacgcctgtttaatcatcccggccagtgatcccggagcacggtaatcaccggcacgacaccaggtatcccggttaaccagcagcatcaggtgatagtgttttttacctttgcactccccaaactcccgggcccagacgtaatgcagggttgtgggatgcacgcgtttaccttcccgatgcttacgtttctggtaagcgtcgattcgggctttcagggcattaatgaagcgggatatcacagctgcgtccgttgctgccggtacatccgggaaacgcaggtcaacccgcaatgccgtcaggcggggatgaacattcagtgcgtgccgcaccgtctcacgaatacgttgctgccagaaggggttgtatttgtaggtcatggttaaatctccgtatggttcatacggaatagccacgtcgtaaaaaatgcgcagagtccctgaagtgacctccggcaggacactgtctcaggcactctgtgataacccgaacggtcgtctccggactgacggttgaattttcagcgttgtttttttaatgtaaaaaaccggttacgggtaaggctgtgaggagggagtgatggtgatacgcaaaaagaagtgcagggactgtggaaacgcgattactcataatacagtgtgttgcccgtattgtggttctgtcgaccccttcggctattaccggaatacagaccgtatcgttaccatactgctggcactgattattgtggtcctgctgactactgtcagcgtcagtgtgtatatactgtgtagctggtgagataacggttcatgtatcccctgagctgacagtgtaccgggtatattaagcgtaaccgacaggttctccttcataccatattaaatttttccaggtattgccgctgccttatttcgtcccatacaggaaaactcgtctgggtttctgacaaatacgcgaaactcacagcccctcaatatcaaccacacgctgtaagccggtaatacctgaaaatcagcctattaccgcccgcgcctccgttaccgaacgctcaggtgaccagactgaagcccagcacgcactcgtaaaatttgcggtcagttccgtcagtcagtgggcaaccgcagagttacgggcttccaggtccacaggagtgagtctataacgcgtgtgggaaatcattttttctggcgttgacagaacgccttacgggctgctacttacccggtgtcccgcaatacagccttagtgttccgttatcggggatccggacgcaccgcaacaaccggggaagtatttctggttagagctgtgtcaagagggatttctcagcccctcactcaccggctcagtctcagggcagaagcattaatacactcagttcatgtcttatacaggaatgggcacagggggagctggcgtgtcactgctgattttacgcatcagcgttcatgtatttgcactctgatacagaatgcttcaagtgcaaaaggaaaacgtatccatacccgggccattcacagcattgataccgacattaagctcaatcgcgcattgtgggtgatggcagaaacgatgctggagagcctgcgctgatgccgtttccctgagtgagggaatcattcagctttcgttcctgaaaaacacacatttatttgttatttaaggagttatctcatgaaaaccgtttctcagaatacccccacaatttattcagctacaacaccagagaataatccgcctcagttggttgccagcctcgtccctgatgaacagcgcatcagcttctggccgcagcattttggcctcattccacagtgggtgaccctggagccccgtgtcttcggctggatggaccgtctgtgcgaagactactgcggtggtatctggaatctgtacaccctgaacaacggcggggcatttatggcacccgaaccggatgacgatgatgacgaaacatgggtactgttcaatgccatgaacggtaaccgcgcagaaatgagcccggaagccgccggtattgccgcctgtctgatgacgtacagtcatcatgcctgtcgtacggagaattatgccatgacggtccattattaccggttgcgggattacgccctgcagcatccggaatgcagcgccattatgcgcatcatcgactgaatggagagaagcacaatgcaacaactttcctttctgcccggagagatgacgcccggcgagcgcagcctcattcaacgggccctgaaaaccctggaccgccatcttcatgaacccggcgtggccttcacctccacccgtgcagcacgggaatggctgattctgaacatggcgggactggagcgtgaagaattccgggtgctgtatctgaataaccagaatcaactgattgccggtgaaaccctctttaccggcaccatcaaccgcacggaagtccatccccgggaagtgattaaacgcgccctgtaccacaatgccgctgccgtggtgctggcacacaatcacccctccggtgaagtcacacccagtaaggcagaccgccttatcacggaacgtctggtacaggcactgggcctggtggatatccgggtgccggaccatctgatagtcggtggcaaccaggttttctcctttgccgaacatggtctgctttaacccttcacaaccacatcacacctgttttcacttttatcttctgtcttcagaggtatcccattatgaaaattatcacccgtggtgaagccatgcgtattcaccaacaacatccgacatcccgtctttttccgttctgtaccggtaaataccgctggcacggcagtgctgaagcgtataccggtcgtgaagtgcaggatattcccggtgtgctggccgtgtttgctgaacgccgtaaggacagttttggtccgtatgtccggctgatgagcgtcaccctgaactgagtgggaattctgatgagcagaattatcgccactaccggaccattcttagccgattttctgtaaggattttatcgtgtcagacacactccccgggacaacacttcccgacgacaatcacgaccgcccctggtgggggctgccctgcaccgtgacgccctgtttcggggcacgtctggtgcaggagggtaagcggttgcattaccttgccgaccgcgccggtatcagaggcctgttcagcgatgcagatgcgtaccacctggaccaggcctttccgctgctgatgaaacaactggaactcatgctcaccagcggtgaactgaatccccgccatcagcataccgtcacgctgtatgcaaaagggctgacctgcaaagccgataccctcagcagttgtggttacgtttatctggctgtttatccgacgcccgaaatgaaaaattaactctccagaatagccttctgctacggcctggtgttttcaccacgccacttttccatttttatatctgcatatcaggaaaatcttcagtatgaaaacattacctgtattacccgggcaggcgaccagttctcgcccgtctcctgttgaaatctggcagatactgctgtcccgactgctggaccagcactatggcctcacactgaatgacacaccttttgccgatgaacgtgtgattgagcagcatattgaggcaggcatttcactgtgtgatgcggtgaactttctcgtggaaaaatacgcgctggtgctaccgaccagccgggattcagcgcctgtacccgctctcagttaataaacagcatcgatatcctccgggctcgcagggcgaccggcctgatgacccgcgacaattacagaacggtaaataacattaccctgggtaagtatccggaggcgaaatgatgacactggaagccgacagcgttaacgtacaggcgctggatatggggcacattgtcgttgacattgatggtgttaatatcactgaactgattaataaggccgctgaaaaaaggttattcactccgcgtggtggatgaccgtgactctaccgaaacaccggcaacttatgccagccctcaccagttgctgtaagacaatgcagtgatgcagggtatagtgccattaaccacagaaacagcactgttgtcctgtattaagcaggcaagagaagatgtccttaccctgcgccatctgcagcttctgcaccagaaccggtgaatctcactcaacaggcttcatttcccctgacgccagcctgaatacagctggcgttttcatttataaacagaaaggaaaaccgataataatggaatggacgccccgaccatgaagcaacggtaggatattactgataaaccttccagtggaggtgcgttatggccgttttaacgattagcattgacctgacaaaaaatgaattccaaatccacggtctgggtaggaacagaaaaatctaagctcagaaaacggattaaagtaagcgtcaacggagcaccgtattgacgcttatttattggtgagaactacgttccatggcaggagttcgtcaacacggttggagggccattccggcagtatgctcagaatatggcgcagatacgcttccggatcgataccgttcagacggcaggtgcctgcttttccggcaacaagcaggaatctcagcgctgaagcaggaattagaggtaaaaacgccctaccgggccatgaatcacccggtcattggagtagtaaccaaagcagatttagccagcatggaacaaatatctttggtgaaaagttggttacgggaagctggagcgcacaacgtgttagtaaccagtgcagttaataacaatggagttacagaactttttgccttgctgcatacagaagaaggctgttgttaatttcgattggttctcagatgagaatgatgacggtgatacacagataagaatcaatgagcaatgagggttgccgggcaaccctcattgaataaaacgggaattacttcgcttcgccgtttttcatttcgcccatagctttcagctttttggagatatcgcggcgttctttggagagctcggcatttttgatgatgtaatcgtcaacgcgatcttcatagtcacctttcatgctggcgatgatgccctggattgcttcaacgctcatccctggcttgatgtaatcgctcaggttgtccagcaacaggacgcgcttctggttgtcacggatctttttctcaacgtcctgaatttcacgttgcagtttgttcttacgacggaacagacgaacaaattccagtacgtcctggaatgaaggcttggtagtttccatttttatacccctgataatgtgagagtcggattcgtttaagcaaccgctattcgttagggccaacattactcatagctgccgcagatgacaatgcttttatcccttttcactatcataccctttatccttgctgaatcgaagcagcagcaagatgattctgaagttcaggaattatttgcgcaaggcccggcaaatcagattcgatagcaactcaagctgatgtgccgtctccatgttcagccacacataaccatagattggtgtttccacaaccttcaggtcatggtggttattgagcaactgacgcagctcttccacagcatcgttcaatttttccgtattggcaaaaaccggctgcggattaccttcgtacagcgcatgaacaaggctcagcagtatttgctgcatcatatgctgggtatcacgaagtttttgcgcgttcaataacacgaaatggctggggcgcgtggcccagtacgcattgatttgcaactccagcatacaaaccagattgcgattaatggtctggataccttcatatatcgattttggaatacgagtttctttgctggcgggcgcaatcagcccacgcattttcacggcatcggtcaggagtttttgtagatggctttccagacgtgggcgttcgagtaagttcggtgagaatgcagattgatagacccgattatactcggtcagacttttcgccagttgaatgcgccagtggatgaacgcccgttgtggccagataccggtaaacaacattgcgagtaaagagccgaggatcacatcgccgcttcgccataacgccgtatcaatttcacctgtcggggaacccacaacaattgccagcgtcaccccaatcaataatccttgatacggtttcttgcccagtgccagccaaccgcaaagaaacatagccgccgcgcaccagactaacatcagcggtaacgaaattaactccagttgcagagcgataagacctaatatcgaacccaacaccgtaccgccaatacgttcgaaggctcgagggacaacgttaccccagaacgagatgggccccataatcaccaccatggtgaccagcggccaggtactttccgggatagtaaacaggcggataatgagaaaagtgagcaggaatgccagcgcgacccgagtaccatgcacaatgcggtaatggcggtatacccggatttcaaacgggcttaatgacttatcggcacgcacgcagaaactccgtaatgaagattaaaagcgctcataactcatctgtcggccagaaggcgcgcctctgaattatccgacggacaaaccgggaacagtgtaatttcccggcaggagcgaaaaaattgaaaggcgcatcttactcttttcgctttcaaaaaaaagagtggtcatcgcgtcaacacaccgccctgagatgaattagtgatgttttggctgcaccgcaacatacatttcgatatcccagtacccatcttccgcgccattgttcaaataaacctcgaagcagggctttggtaacatttcataagcactgtcctgcaagaggctattaaagaactgataccagggtttagcaaaatcatcaccgactacacgagctaccgccaccgcatactgaccacctgaaatttctgtcaaaatgacgccctcactgttttcgggaagcgtaaagtaacccggcaccgtcacgacggtgtcgcagcgtaatttttcggcgggtgtttcatctggattgtcgtaatagacagcaacccactccttcggcacaatatttttgctatctacccacatcatcaactgctcaaagcctttctttaccgtctgttcccacgggccaacgagatggaaacctgcaacggtacgtttctcttcctgcttaatctcgtagttcatgacgcctccattaatactgtttttatatacagtatagttgcaatattaaaaccacaaggaatgagtgttgattatgcgagcagactcgcactcctgccagtctgctgcaaaagaaaggtcaggccttatggtggaaataatcactaaggcgagaaaacatgctgccttccccgacagattccagggtaaccagcggccagtgcgccacctgtttatcacggtcgtaaagttcaatttcccctacccgctgatgggcgctaattggcgcggtgagttctttaccatcaagggtatatttggctttgatatgtggaatttcggctttcggtagtaccatccagaactcttgttctgttcccagggcgatattttctttatcgccataccagatgcgttccgtaccgacctttttcccacggtgcaaaatttgcaccgtagtaaagttttgttgcccccaacgcagtaattttcttgcctcttcctcacgaccttttgcgctgtcagcccccattaccactgcaatgagacgacgctgcccatctacagccgaagcaatgagattaaacccggcaccagaagtatgacccgttttcaggccgtcaatattcatggttttatcccacaataacccgttacggttttgctgggtgataccgttccaggtgaggcttttctcactgtacatatgataaaactcgggctcgccgtggatgatagcacgagaaagcacagctaaatcataagccgagctatgctgacctggcgcatccaggccatgcactgtttcaaaatgcgtatccttgagatgcagcttctcggcatagttgttcatcatttcaacaaactgccgttgcccaccggcaatatagtcagccaatgcaacacaagcgtcatttccggaatccacaattaaaccacggcttaaatcacgtaccgatacgcgatcgccctctttcaaaaacatcagtgaagaaccgacaaacaccggattatctttcgcccacgcatcgcgccccacggtgacaatatcgtctggcgtaatgcgatgactatcgatagcgcgatccacgacatagcccgtcatcagctttgtcaggctggcgggattgcgctgttgatgctcattacccgcggtgaggatctgtccggtggtgtaatccatcagtacccaggacccggcatgaatctctggaggctgaggtgaaaaaggaatgttttccgccgcaaaaccagacgataagttaaaaacgaacaaagaagcagcaataataagacggcgtttcaacagcaaaccctcaggagtttcaaatagctgttctttttacggaaatacttatgaactggctggaataaagtgcaagaaaatgtgactaccctctcattttcatctgacatgatctgttgctactcgctgtcaaattgtcgcgctaaagctgattagcacggtgatatttgatactctggcagacagcagaaataacggatttaacctaatgatgaatgacggtaagcaacaatctacctttttgtttcacgattacgaaacctttggcacgcaccccgcgttagatcgccctgcacagttcgcagccattcgcaccgatagcgaattcaatgtcatcggcgaacccgaagtcttttactgcaagcccgcggatgactatttgccccagcctggagcagtattaattaccggtattaccccgcaggaagcacgggcgaaaggagaaaacgaagccgcgtttgccgcccgtattcactcgctttttaacgtaccgaagacctgtattctgggctacaacaatgtgcgtttcgacgacgaagtcacacgcaacgttttttatcgtaatttctacgatccttacgcctggagctggcagcatgataactcgcgctgggatttgctggatgttatgcgtgcctgttatgccctgcgcccggaaggaataaactggcctgaaaatgatgacggtctaccgagctttcgccttgagcatttaaccaaagcgaatggtattgaacatagcaacgcccacgatgctatggctgatgtgtacgccactattgcgatggcaaagctggtaaaaacgcgtcagccacgcctgtttgattatctctttacccatcgcaataaacacaaactgatggcgttgattgatgttccgcagatgaaacccctggtgcacgtttccggaatgtttggggcatggcgcggcaacaccagctgggtggcaccgctggcgtggcatcctgaaaatcgcaatgccataattatggtggatttggcaggagacatttcgccattactggaactggatagcgacacattgcgcgagcgtttatataccgcaaaaaccgatcttggcgataacgccgccgttccggttaagctggtgcacatcaataaatgtccggtgctggcccaggcgaatacgctacgcccggaagatgccgaccgactgggaattaatcgtcagcattgcctcgataacctgaaaattctgcgtgaaaatccgcaagtgcgtgaaaaagtggtggcgatattcgcggaagccgaaccgtttacgccttcagataacgtggatgcacagctttataacggctttttcagtgacgccgatcgcgcagcaatgaaaattgtgctggaaaccgagccgcgtaatttaccggcactggatatcacttttgttgataaacgaattgaaaaactgttgttcaattatcgggcacgcaacttcccggggacgctggattatgccgagcagcaacgctggctggagcaccgccgccaagtcttcacgcccgagtttttacaaggttatgcagatgaattgcagatgctggcacaacaatatgccgataacaaagagaaagtggcgctgttaaaagcgctttggcagtacgcggaagagatcgtctaatttgaagcctccgccgctggtacggcggaggtcaatgttgagtcaggctttttgaacggtgatactccacgctgcatcgccaatctgctgataatcggtgatggcatgcccttcttctgccgcccactgtgggattgcttcagttgcctgggtgcaatcaaactcaattaccaactcatcgccgctggccatttctgccagtgctgcttttgcttctatgagtggaaacggacagacctgcgtcaccacatccagctttttaatcgccatctttacaccttacttaatttgccgcagcagttgccagtcgcgccttacgctgcggtcgaacatacacaagccaggacgcagtccagactccgagaatcataaatacaaggccaatccagccctgccaggtcatcattgcagtcataaccagtccattaccgatagagcaaccacctgcaatactggcaccgaagcccatcagtacaccacctaacccgctacgtaatgttgtttgtgcatcagctgcgcgaacgcggaactcacggctcgctttggctgcaataaatgacccctcgaagatccctaacaccaggaaaacgccccagttaatgtatttcacgtcacccgcgaccagaaattgcagaatattggccgttggggaagtgattcctaacccaaacatgcgtccggttgcttcactcaggggccaggctaaaagcgcaatcaaaccgatgagtacagcagtgacaaagggatgccagcgtttttcaaacagaatatgagcgatcccggttcggcgcggcggtaaggtcgcgactttgagttttggcttcttcaactctttcatcaccaccaagagcgttatcaccagcaaaacggtaaccaacggccacacagacaaattaaaagtctcagcaatagagttatgttcagtactgtagtgctgcaaggtttgatttaaaccactggcatgtggagaacgcatcaccgcactcatcaccatataagtgaaaagcgcgatccaactgccgatcaatccctcacccgcgcgataccaggtcccggtggcacatccacccgccagaacaattcccagcccgaagatatacccacctataacagtaccaagccacgggaacgccccggcttcgtaagtcagtaggcccgcctgaattaacgcaaaaacccccacgctttgtaccgaaattgcaatcagcaaggcgtaaaacatgcgattatttttcgcgatatacatatcgcgaaaaccacctgtcaggcaaaaacgcccacgctgcatgacaaatcccagcagagcaccacaaattagcccgcttaatatcattgaaaacataaattaattaaccagatgaatgttaatgaggaaattattcatgactggtggaatgcagaccaataaccaaattctctaaattagaacaaatggttattaatgaggatgtcgataaaaaagaataaaaaaaccggagccaaatattcattcgactccggtttattattagaaaagatgattatgctacgtcttcgtactgcggaaccgggttacggaagctcttggtgacgcaagccaggtaaatcagaccgatagcagcccagatcagacccagaaccattgagctttcttccaggttaacccacagcgcaccaacggtcagcgcaccacacatcggcaggaacagatactggaagtgatctttcagcgtcttgttacgcttctcacggatccagaactgcgagatgaccgacaggttaacgaaggtgaacgccaccaacgcaccaaagttaatcagcgccgtagccattaccaggtcgaagttgattgccagcagggcaatcgcgccaaccaggatgatgttcattgccggagtacgccatttcgggtgtacataaccgaagaagcttttcgggaatacgccgtcacgacccattacgtacatcagacgcgcaacacctgcgtgcgccgccataccggacgccagtacggtaatggtggagaagatcagcgcaccaacctggaatgctttacctgccacgtacagcatgatttcaggctgtgacgcatccggatctttaaagcgagagatatccgggaagtacagctgcaggaagtaagttgcaaagatgaagatcatgccgccaatcagcgcggtcaggaaaatcgcacgcgggattacgcgctctgcatctttggtttcttccgacaggttgctgatgccgtcaaagccggtaaaggagaagcacaggattgtcgccccggtaatcatcgggataacatgcgcatcgccagaccagaacggacgagtgctcgccagcgtaccagcgccttcaccttcaaatacgccataaacaaccatgcccagaatcaccgcgatcagcactacctgcaacacgacgattacagtgttgaagttcgctacggatttcagactacgcaggttaaaggcggtcataaaggccaccagcgccaccacaaacatccacgatgggatggaaggcaccagagcttcaaaataaattttcgccagcagaatgttgatcatcggcgcgaacagatagtcgagcagagaagaccaacccaccataaagccaaccgtcgggctaatggatttctgggcgtaagtgtatgcagagccagcagaaggatagcggcgaaccagcttcccgtagctcagagccgtaaacaggatcgcaatcaatgcgaacgcataggctgtcggcacatgaccatccgtgaggcctgaaacgataccaaaagtatcaaacagcgtcatcggctgcatataggcaagacccatcattacaaccggaactaacgtaagcgttttacgcaattccacgcgagaggtgtttggagtaacgttatgcgacatggtcattctcctttacggtgataaccgtcgcgtaagcaaaaaattgccccatttttttggattcctcagcgacaacaactgtcgatttttagtaaatatctatccggtacgaagcccggcctcttggtatgaatgattggtttgaagcaaaaaataaccgacgctgatgaaacgtcggtttttagtcattttttgacagcggcgcattgtgcctaaatgggggggaaatgacaagagaatgagaggcttgtcataataatttttctttaaatggctgattttccgtcatcagattttgcataaacaccggcgatcgcactatttgctaaaatttcatcccgccaccagccgctggcaagccctgcggtctgttcgttccagccaatccagacgggttcaaagagagtttgggcgaccactttcttctctattaacgcgccactatcgagaaaacgttgtgccagataacggggtaaatagccgcagccgaggccgctaatttgcagctccagcttggttttaaaatcgaaaacggtaatggcttcttgttcgtcgagaagttgtgaggccgtagaagcgcctgcctgcgcagtatcccccaccacaatcgcccgatatcgcttaataatacgacggtttaacggctcttcttccagggctaacggatgatgaggcgcgaccgcaaagacttgttccagatcgcccaaccgtgaaaaaccaaactcactggaagatggtggctcatgcatcgcgccaacaataatatccgctcgcccctgagtcagggcatcccaggaaccaccgagtacgccattgataaacttcaggcgcgtcacgctatgatgttgataaaaagcttcaatcagtggcgcaagcagagaaaaaggaaacgtgtcgtccacgccaatcaccagctcgttttcccagccttcatgcagtttgatcgcctgcttttccagttctcgcacggtatgcagaacttcccgccctttctctaataacatttttccggtacgggtgaatttagcgcggtgaccgctacgatcaagcaattgaatattaaggtcgctttccagcttgtgaacggtgtaactcagagcggacggcgtcttatagagtttggccgacgccgccgcaaaactgccttctttttctaaagcatcgaggatcatcaacacatccagcagtggtttcatacacgcccccttgcagtgcatgcggcgtcctgctggcgtgatcgtttactccagcggcattaccagcggatcgggatactggtattcaaatcccagttcattacaaatccgactgccatcaataatcttacctttgccgctgtccagactatttctgaactgcggaggctccagccccagtaaacgggccatctgcggatagaaaacattacgcgcagggtgagctggcgcacatatattatagatgtgtccgcctttaggtgcctgtaacaacagagtgatagcgccaataacatcttctaaatggactaaattaacaccatgttcaccatcaggcgcggtttttccggcaaagaagcgtccgggatgacgtcccggtccgaccagccccgcaagacgcagaatatcgaccgaagtaccgggtaaattgtgcagccagtcttcgagttcttctaatactcgtccactgttggtcaccggattacgcggggtggtttctttcaccgtgccttgcgcgtcgccatagacagatgttgagctggtgaaaataatgcggggaatacgatgggccagcgcgctatccactaactcttgtaccgcttgtaaatagaactcatcgccggggccgctacgacgtgccggaagcgtaatgaccagcgcgtcggcatccatcagggcatccagatcgtcagaatcgcaaactagctcaggctccatgcgaagcagatagctatcaatgccactcattcgggccgcttcgacaccatcttgtgtggttttactcccggtgacttgccagcctcgcgctgaaagtgacatcgccagcggcatgcctaaccaccctaacccgacaattgcgacctttttcatccgttatctcctgatacaccttagatctataaggctacgctagcgtatcaaaactgacaattcattctatgaatgaaatcgaaactgttagcaaatataccattgcctgatgcgctccgcttatcagtcctacaaaacatcaatatattgaatttaggcaacatttgtagacctgataaggcattcacgccgcatccggcaggaacaaagcccactttagttacagaccacaatgttcttgagggttttaaagacatattttcacgattacttttctaacgtagtcactccaggccccctcctttccccgctcattcattaaacaaatccattgcaataaaatatataaaaaagcccttgctttctaacgtgaaagtggtttaggttaaaagacatcagttgaataaacattcacagagacttttatgacacgcgttcaatttaaacaccaccatcatcaccatcatcctgactagtctttcaggcgatgtgtgctggaagacattcagatcttccagtggtgcatgaacgcatgagaaagcccccggaagatcaccttccgggggcttttttattgcgcggttgataacggttcagacaggtttaaagaggaataagaaaatgacagacaacactcgtttacgcatagctatgcagaaatccggccgtttaagtgatgactcacgcgaattgctggcgcgctgtggcattaaaatcaatcttcacacccagcgcctgatcgcgatggcagaaaacatgccgattgatattctgcgcgtgcgtgacgacgacattcccggtctggtaatggacggcgtggttgacctcgggattatcggcgaaaacgtgctggaagaagagctgcttaaccgccgcgcccagggtgaagatccacgctactttaccctgcgtcgtctggatttcggcggctgccgactttcactggcaacgccggttgatgaagcctgggatggcccgctctccttaaacggtaaacgtatcgccacctcttatcctcacctgctcaagcgttatctcgaccagaaaggtatctgttttaaatcctgcttactgaacggttctgttgaagtcgccccgcgtgccggactggcggatgcgatttgcgatctggtttccaccggtgccacgctggaagctaacggcctgcgcgaagtcgaagttatctatcgctcgaaagcctgcctgatacaacgcgatggcgaaatggaagaatccaaacagcaactgatcgacaaactgctgacccgtattcagggtgtgattcaggcgcgcgaatcaaaatacatcatgatgcacgcaccgaccgaacgtctggatgaagtcatcgccctgctgccaggtgccgaacgcccaaccattctgccgctggcgggtgaccaacagcgcgtagcgatgcacatggtcagcagtgaaaccctgttctgggaaacgatggaaaaactgaaagcgctgggtgccagttcaattctggtcctgccgattgagaagatgatggagtgatcgccatgagctttaacacaatcattgactggaatagctgtactgcggagcaacaacgccagctgttaatgcgcccggcgatctccgcttctgaaagcattacccgcactgttaacgatattctcgatagcgtgaaagcacgcggtgatgacgccctgcgggaatacagcgcgaagtttgataaaaccacggttaccgcactgaaggtgtctgctgaggaaattgccgccgctagcgaacgcctgagcgacgagctaaaacaggcgatggcagtggcagtaaagaatattgaaaccttccacactgcgcaaaaactgccgccggtagatgtagaaacgcagccaggcgtgcgttgccagcaggtcacgcgcccggtcgcttcagttgggttgtatattcctggcggctccgccccgctcttctcaacggtattaatgctggcaactccggcgcgtattgcgggctgtaaaaaagtggtgttgtgctcaccgccgccgattgccgatgagatcctttatgcggcgcagctgtgcggtgtgcaggacgtgtttaacgtcggcggcgcacaggccattgccgcgctggcgtttggtacggaatctgtgccgaaagtggacaaaatcttcgggccgggtaacgcctttgtcaccgaagcgaaacgtcaggtgagccagcgtctgaacggtgcggcgatcgatatgcccgcaggcccgtcggaagtgctggtgattgctgacagcggcgctacgccggatttcgtggcttctgatttgctttctcaggctgaacacggcccagactcacaggtgattttactgacgcccgctgctgatatggcgcgtcgcgttgccgaggccgtcgaacgccagttggcagaactgccgcgtgccgaaaccgcccgccaggcactgagcgccagccgcctgatcgtgactaaagatttagcgcagtgcgtagagatctccaaccagtacggcccggagcacctgatcattcagacccgcaacgcccgcgaactggtcgatggcattaccagtgccggttcggtatttctgggtgactggtcaccggaatcggcaggtgattacgcctccggaaccaaccatgttctaccgacttacggctacaccgccacctgttccagcctcggactggcggatttccagaagcggatgaccgtgcaggaactctcgaaagtaggtttctccgcgctggcttcgaccattgaaacactggccgccgccgagcgcctgaccgcccacaaaaatgccgttactttgcgtgttaacgcccttaaggagcaagcatgagcaccgtgactattaccgatttagcacgtgaaaacgtccgcaacctgacgccgtatcagtcggcgcgtcgtctgggcggtaatggcgacgtctggctgaacgccaacgaatatcccacagtcgtggagtttcagcttactcagcaaacgctcaaccgctacccggaatgccagccgaaagcggtgattgaaaattacgcgcaatatgcaggcgtaaaaccggaacaggtgctggtcagccgtggcgcggacgaaggtattgaactactgattcgcgctttttgcgaaccgggtaaagacgccatcctctactgcccgccaacgtacggtatgtacagcgtcagcgctgaaaccattggcgtcgagtgccgcacagtgccgacgctggaaaactggcaactggacttacagggcatttccgacaagctggatggcgtaaaagtggtctatgtttgcagccccaacaacccgaccgggcaactgatcaacccgcaggattttcgcaccctgctggagttaacccgcggtaaggcgattgtggttgccgatgaagcctatatcgagttttgcccacaggcatcgctggctggctggctggcggaatatccgcacctggctattttacgcacactgtcgaaagcttttgctctggcggggcttcgttgcggatttacgctggcaaacgaagaagtcatcaacctgctgatgaaagtgattgccccctacccgctctcgacgccggttgccgacattgcggcccaggcgttaagcccgcagggaatcgtcgccatgcgcgaacgagtgacgcaaattattgcagaacgcgaatatctgattgccgcattgaaagaaatctcctgcgtggagcaggtttttgactctgaaaccaactacattctggcgcgctttaaagcttccagcgcagtgtttaaatctttgtgggatcagggcattatcttacgtgatcagaataaacaaccctctttaagcggctgcctgcgaattaccgtcggaacccgtgaagaaagccagcgcgtcattgacgccttacgtgcggagcaagtttaatgagtcagaagtatctttttatcgatcgcgatggaaccctgattagcgaaccgccgagtgattttcaggtggaccgttttgacaaactcgcctttgaaccgggcgtgatcccggagctactaaagctgcaaaaagcgggctacaagctggtgatgatcactaatcaggatggtctgggaacacaaagtttcccgcaggcggatttcgatggcccgcacaacctgatgatgcagatcttcacctcgcaaggcgtacaatttgatgaagtgctgatttgtccgcacctgcccgccgatgagtgcgactgccgtaagccgaaagtaaaactggtggaacgttatctggctgagcaagcgatggatcgcgctaacagttatgtgattggcgatcgcacgaccgacattcaactggcggaaaacatgggcattaatggtttacgctacgaccgcgaaaccctgaactggccgatgattggcgagcaactcactaaacgagaccgttacgcccatgtagtgcgtaacaccaaagagacgcaaattgacgtccaggtgtggctggatcgcgaaggtggcagcaagattaataccggcgttggcttctttgatcacatgctggatcagatcgccacccacggcggtttccgcatggaaatcaacgtcaaaggcgacctctatatcgacgatcaccacaccgtcgaagataccggtctggcgctgggcgaagcgctaaaaatcgccctcggagacaaacgcggtatttgccgcttcggttttgtgctgccaatggatgaatgccttgcccgctgtgcactggatatctctggtcgcccgcacctggaatataaagccgaatttacctaccagcgcgtgggcgatctcagcaccgaaatgatcgagcacttcttccgttcgctctcatacaccatgggcgtgaccctgcacctgaaaaccaaaggtaaaaacgatcaccaccgtgtagagagcctgttcaaagcttttggtcgcaccctgcgccaggccatccgcgtggaaggcgataccctgccctcgtcgaaaggagtgctgtaatgaacgtggtgatccttgatactggctgcgccaacctgaactcggtgaagtctgccattgcgcgccacggttatgaacccaaagtcagccgtgacccggacgtcgtgttgctggccgataaactatttttacccggcgtaggcaccgcacaagcagcgatggatcaggtgcgtgagcgcgaactgtttgatctcatcaaagcctgtacccaaccggtgctgggcatctgcttagggatgcaactgcttgggcggcgcagcgaagagagcaacggcgtcgacttgctgggcatcatcgacgaagacgtgccgaaaatgaccgactttggtctgccactgccacatatgggctggaaccgcgtttacccgcaggcaggcaaccgcctgtttcaggggattgaagacggcgcgtacttttactttgttcacagttacgcaatgccggtcaatccttggaccattgcccagtgtaattacggcgaaccgttcaccgcggcggtacaaaaagataacttctacggcgtgcagttccacccggagcgttctggtgtcgctggcgctaagttgctgaaaaacttcctggagatgtgatgattattccggcattagatttaatcgacggcactgtggtgcgtctccatcagggcgattacggcaaacaacgcgattacggtaacgacccgctgccgcgcttacaggattacgccgcacagggtgccgaagtgttgcacttggtggatctgaccggggcaaaagatccggcaaaacgtcaaatcccgctgattaaaaccctggtggcgggcgttaacgtccctgtacaggttggcggcggcgtgcgtagcgaagaagacgtggcggcgttactggaagcgggcgttgcgcgcgtggtggtcggctccaccgcggtgaaatcaccagaaatggtgaaaggctggtttgaacgtttcggtaccgatgccttagtgctggcgctggatgtccgtattgacgagcaaggcaacaagcaggtggcagtcagcggctggcaagagaactcgggcgtttcactggaacaactggtggaaacctatctgcccgtcggcctgaaacatgtgctgtgtaccgatatctcgcgcgacggcacactggcaggttctaacgtctctttatatgaagaagtgtgcgccagatatccgcaggtggcatttcagtcatccggcggcattggcgacattgatgatgtggcggccctgcgtggcactggcgtgcgcggcgtaatagttggtcgtgcattactggaaggtaaattcaccgtgaaggaggccatcgcatgctggcaaaacgcataattccgtgtctcgacgttcgtgatggtcaggtggtgaaaggcgtacagtttcgcaaccatgaaatcattggcgatattgtaccgctagcaaaacgctacgctgaagaaggtgcagacgaactggtgttctacgatatcaccgcttccagcgatggccgtgtggtagataaaagctgggtatctcgcgtggcggaagtgatcgacattccgttctgtgtggcaggtgggattaagtctctggaagatgccgggaaaattctttcctttggcgcggataaaatttccatcaactcccctgcgctggcagacccaacattaattactcgcctggcggatcgttttggcgtgcagtgtattgtggtgggtattgatacctggtacgacgctgaaaccggtaaatatcatgtgaatcaatatactggcgatgaaagccgcacccgcgtcactcagtgggaaacgctcgactgggtacaggaagtgcaaaaacgcggtgccggagaaatcgtcctcaacatgatgaatcaggacggcgtgcgtaacggttacgacctcgaacaactgaaaaaagtgcgtgaagtttgccacgtcccgctaattgcctccggtggcgcgggcaccatggaacacttcctcgaagccttccgcgatgccgacgttgacggcgcgctggcggcttccgtattccacaaacaaataatcaatattggtgaattaaaagcgtacctggcaacacagggcgtggagatcaggatatgttaacagaacaacaacgtcgcgaactggactgggaaaaaaccgacggacttatgccggtgattgtgcaacacgcggtatccggcgaagtgttaatgctgggctatatgaacccggaagccttagacaaaaccatcgaaagcggcaaagtcaccttcttctcgcgcactaaacagcgactgtggaccaaaggcgaaacgtcgggcaatttcctcaacgtagtaaatattgcgccggactgcgacaacgacacgctactggtactggcgaatcctatcggaccaacctgccacaaaggcaccagcagctgcttcggcgataccgctcaccagtggctgttcctgtatcaactggaacaattgctcgccgaacgtaaatctgccgatccggaaacctcctataccgccaaactgtatgccagcggcaccaaacgcattgcgcagaaagtgggcgaagaaggcgtggaaaccgcactggcagcgacagtacatgaccgctttgagctgaagaatgaggcatctgacttggtgtatcacctgttggtgctgttgcaggatcaggatctggatttaacaacggtgattgagaacctgcgcaaacggcatcagtgagttgcggggtaagcggatgcgacaacaacatcgcatccggcaaaaaaaacgggcaaggtgtcaccaccctgccctttttctttaaaaccgaaaagattacttcgcgttgtaattacgcagagcgttacgccccagcacaatccccgcgccaaccatgccgcccagcagcaccgccagaatcaaggtaattgcctttttcgggctatcgcgacgaataggtaacgtcggtttcattacatagcggtaagcatgaatatcaagtttatcaacgtcaagattgtcgatatccagcaggttttgacgagtctgatagtagtttgatgagaacaccaacggacgagtcgcctcgtgcttaatcatcgactccagcgcttcgctccccaaaaggaacatagtatcttgggttacgtcctgtgtctgctgaatctgcggctttgtcacctgcgcctgattcgcatactgcaacgcttcctgaatctgacggatacgcagatctttctgctcctgcgcaaccacttcctgggtcttcagagaatcctgcaagtttttcatttgcagcgcgatgttgtctttcaggtcttgttccagttcttcatttacctggtcgtcaacttgctggatatacttcgccagctgtttctgcgcaccttcaggtgtttcacccacataagaaaccgctaaaggtaatgactgatttttaacggtaggctcaatggtcagtttttcaggttcttcctgattatccagcgtttctgctaatgcagaaaatgtcgtgctgaaacgaccaattaacatcgactggatctcagacactttcggcgctgccgaaccataaatcacatttatggcattgttataaccagcgatttgccccacatcaggttgagtaacgatagctgtggaagtccacttttctttggcaacggccagataccctatagccagggcaatagccacaatgacagagatgataattgtcatcttgccacgccacaactgcaccagtaaatcaatcaaatcaatctgttccgggtcatggttttgcccagaaacattattattttctactctcatcattaccctaacggacgaaataattttaagtcgccatagtttagcgataatcgccatgaatgctataggataaatgataaaaaaaatgaattattacaaagggaacataagagaatcagggcgaaaatcgccctgataacatgatgttagtcgctgccaaaaagatcgcgggtgtagactttgtctgccacatccttaagctcttctgccatacggttggagataatgacgtcggcttgttgtttgaaggtggcgagatcacgttccaggcgagagttgaagaatgaatcttctttcatcaccggttcgtagatgatcacttcaacgcctttcgccttaatacgtttcataatcccctgaatggaagacgcgcggaagttatctgacccgctcttcataatcagacgataaatacccaccacttgcggtttgcgtgacaaaatggcatcggcaataaagtctttacgcgtgcggtttgcatcgacaattgccgaaatcaggttattcggcacagactggtagttcgccagtaactgcttggtatctttcggcagacaataaccaccatagccaaacgacgggttgttgtaatggttgccaatacgcggatcgagacaaacgccttcgataatctggcgagtattcagacctaaactttctgcatagctatccagttcattaaagtatgctacgcgcatcgccagataggtattagcgaaaagtttaatcgcttctgcttcagtggagtcggtaaacagggttgggatattttgcttaatcgcgccttcctgtaataacgcagcgaaacgttctgcgcgttctgaacgctcaccaatgacaatacgtgaaggatggagattatcgtaaagggctttaccttcacggagaaattccggagagaaaataatattttcagtacgatatttcttatgcatcgctgcggtaaaaccaacgggaaccgttgatttgatgaccataaccgcataaggatttatctcaactacgtctttaattactgattctacactggatgtattgaaataattagttttaggatcatagtcggttggagtggcgatgatgacataatcagcatcccggtaagcttcatttttatctaatgtggcattaaagtgtattttatctgattgcaaaaactgctgaatttccttatcaacaataggagatatccgatcattcagcatagcaacgcgtgacggtaaaatatctaatgccacaacctcatgattttgtgcgattagaagcccgtttgacaagcctacatagccagtaccggaaatggtgattttcatttcatgctctcagaattaacttaactgtgaatcatgatgtttttagcatcctgataagagctaaaagttttaacgctacgttgtcagatggtcaacgcaacgaaaaacaattcagattttctttataagaatagctgatatttattaagttaatattaagcagtgaaatttagtctataagataattggcaaaaaaaagcccggcgcaatatacgccaggcctcaatttattgttagttaaataagattaatccagccattcagtatggaacacaccttctttatcaatgcgcttataagtatgtgcaccgaaatagtcacgctgtgcctggatcaggttcgcaggcagaacagcggcacggtagctgtcataataggcaaccgcagcggcgaaggtgggaaccgggataccgttctgtactgcataagcaacaacatcacgcagcgcctgctgatagtcatcggcaatttgcttgaagtatggagccaacagcaagttagcgatctgcggattttcggtataagcatcggtgattttctgcaggaactgcgcacggatgatgcagccagcacggaaaatcttcgcgatttcgccgtagttcagatcccagttgtactcttcagacgccgcacgcagctgagagaagccctgggcgtaagaaacgattttgcccagatacaacgcacggcgaactttttcgatgaactcacctttgtcgcctgctggctgcgcttgcgggccagagagaactttagatgcggcaacgcgctgatctttcagagaagagatataacgtgcaaacacagactcggtaatcagcgacagcggttcgccgagatccagcgcactctggctggtccatttacccgtacctttgtttgcagcttcatccagaatcacatcaaccaggtagttaccgtcttcatcttttttggtgaagatatctttggtgatgtcgatcaggtagctgctcagttcaccgttattccactcggtaaaggtctgcgccagttcttcgttggtgaggttcaggccaccttttagcagagaataggcttcagcaatcagttgcatatctccgtattcaataccgttgtgaaccatcttcacatagtgaccagcaccatcggcaccaatataggtaacacatggctccccatcttcagccactgcggcgattttggtcaggatcggtgcaaccagttcataggcttctttctggccaccaggcatgatggaaggtcctttcagtgcaccttcttcaccaccggaaacaccagtaccgataaagttaaaaccttctgcagacagctcacggttacgacgaatggtgtcctggaagaaggtgttaccaccatcaatgatgatgtcacctttatcgaggtatggcttgagagaatcaatagcagcatccgtgcctgcacctgctttcaccattaacaggatgcgacgaggcgtttccagagattcaacaaactcttttaccgtaaagtaaggaaccaatttcttgcctggattttcggcaatcacttcttccgtcttctcacgggaacggttgaaaatagagacggtataaccacggctttcgatgttgagcgcaaggttgcgccccatcactgccataccgacgacgccaatctgttgctttgacattgtttactcctgtcagtaatatactgcatggtttgcttaacggtaatatattaacctaaaatgactacttaaagtaataatttaaaaaaatattattgggcaattcaaaataaaatttaaattcataacatattattaatattgtataatatttatctcaatatttacttcgatgttaatgtaaaagtcaccatcgcaaattaatctactttatataatgaaggtgacaattaacactatatatcttgttatctcttatatattagattacttttattcacatgaaacttcatttttaacatgtgcataaatgcgtaaaaagaataattacaccagtaatatatactgctcaaaatattaagcttgagttttttacgatatatattccattgccaaaatgctgcttttaatttatttgatgatactgaatgttccgtaactcgataccgggctaaatttttctgtatgcaataagcgctaccagaaagctttaccaactgtaaccacattagatagtcttcatgtccacattcttcctgtaagcatttacctagtcgttctcggttataaatccccgttaaattgccgatacaattaccgcgtaacaaacgcgaataggtgatctgttgtggtgcagttcgagaaccgattattttttttggttcatttttaaaaatggcataatttgaacaaactacatcatatcctttttcgagtaaagggatttgcaaggataatttttctttttcccaaatgtcatcactatcaagaaacgcaataaatttcccttttgccattttaatacctatatttctagcatttgcaactccactattgataggaagcattacatatgttattcgcagatcggtaaaattagatatttcatgtgcggtattgtcagttgaaccatcatctattatatataaatgccaatcattatatgattgttcaattacagaaatgatgctatacgaaatataagatgcagcattaaacgtaggcatgattatagatactgtttcataactactcatgatattaactccaaccactgccgacttattttttcaacagaataatcattagcatttcttaaggccatactttgtattttgtttcgataaacatcatcgatcattaaagactgaagacgatatgaaaattcaggttcattatcttcagtaatcaagaacccatcttttttgtgatgaataatttcagcaggacctgttttacaatcaaaagcgactgctgctaatccaaaagatttagcctctataagaaccaatggtagtccttcatagcgagaagtcatagctaatatagctgcattagtatattcttgttctatacattttgttgctggtataagttggacattatgtgtaacattcaggtcaacaatcattttttgtagttctgaacgcaattctccatcccctacgatccgtaaaacccaaccgtgattgtccgatatggaagcccaaatacgaattaacctatcaaaccccttctgataagttaaacgtcccactgctaatactatcttttgcttttgaataagaacagattcagataattgttcgaaaccactagcattattgataacgtgagtatgagccctaacatttgacttaagcaatttataatcatgctttgtcaataatacaagatcatcagcgaattgatagcttaaccattttagagaacgaatgaactttgatgaggattcaaaagccacatgctcacttaaaataagacgagattttaatcgtaatagaaaatgtaaacatgcaagcttaaacgataaactacccatggaaacagaaatcaacacatcacatgaattttttcttaaaaaaagaaacaattcgtataatgttgattcacttaaaacctctaacttgactccgggttgcagcggatagtatgtattccctccttctaatgctaatgatattagtgtgactgaaaatccggataaaaacatttgattagagagaaatgtcgcaactcgttctgtgccaccggaacgggatatatcatcaataaaaatatatacttttttcataggcatctagacaataaatagattatataaaaataaaattatgtaaattattatttatatagtaattttttgacaacaaaagcaatatacaaaatgctccctaagtatttcccatttgcgactttaaacattttcttcttcgtactaaaagcgtctttatttggatatgttttatcactagaagtcgtgtcaggatgattcgagcaaattttattagatttatatattttttttccagctctcatcaaatcacatgcaaaaatatattcctcaccggaaggatatttagctcctaacccaaaatctgagttaaatctaataccgtccagtgctgaaatttttaatatcatatctacagaacaaattcccgcagcagttataggattcaatcttttaatcctctctttttcattattatacttttttgccaatgaatgagaaacaaccagcaaaggactatttttataatcactaataaatttcgtcagataatcccaagccgcatcatctatttccatatcatcatccattaaccaaagataatcgtattttgcattttcaatggccatatttcgacttttggacaacccagactcatatgaagatatgtatctaacattttcagggaaagatgccacataatcagagtaatcacattcatcagtaatctgatgaataataagataattataatcattacgaaatttaattttataaattcctgaattcagcgctgataaaccgatctcaatattcaatttgatatcactcaattgtagataatactatatatggtttaagaaagagcttattataaaataagcaaacttaacttaatctgttcttactctataaacttaaaatttgttctattaccctaaactctcatatttaaactcgtcactctctaattctaattccattagcggagttgttagggagtttagcgcccttggttattgcaggttttaccgaaatatactttacaaagtaactgttactgtagtaactacaattttctttgatacatttccaccttgcacatctaaacaatgtcccttattcgtctctagaatatattactggataatatcctttaacaaaataatctatgtcctttattaataaatcaataaaactagtatctaatggatttgaacgcatgtgatttgaaatatcatcgcccttatataacacaacaaagagaaagcaacagttaacaatcatataaagagacaacgatttgatcttatttaatattgttacattgcaggaggtaagaagtggatacaagaaaaacggtgatagtgcgtaaagcaaaatagagattcttatcccaaaattttgtggtattttataagttaccaaggccaagataaagaaaaaagtcaaaaacaatattattctttgagttgacaattcttttcttgcatttgaaaagaataataacaacaaacacaaaatataattaaaagcaatggttacaacttgtacataccccatcgaatttccagagcttttaaataaataaaattcaatcctatctcgcaaaaaaataaaacaacatataatagttacagttgccatactagcaacccatatttttaattttttatttcttgcccttaaatattcccatactcctatatataggacggatgacaaatgcgatataattgcaaaaaaataatacacatacttttttttagaaataaacaaaaaggcattaattaaaaaaaccgcggataacatgcttcgtaaaaaatatgcattaaaagaataataagcatatgaaagattaaatactaaaaaatataaacatgataaacgacgattaacacgataacaaaatacaaaaagaaatatttgaataatagtaaagcaaaaaaataaaaaaagatattcattgccatcggatataaaatacaccaagcgcatgagagctaatatgaagatctcgattccaccaccaaacctaccaaaactaaatatatcaacatcggttactcctctatagataagcatatactctgctatgtctgaaaaaggcgtaatagatgagtataataaaataaaataaaaaatcattaatagtgacatagtccatcttgcatagttattaacaaatggacttgaaagagctataagaggtaacgataccaaagggtatgcactgaaaaatagaatagatattaaaatacataggaaatagtatatttgtaggcgaaaagacccgtcatgattatcattcttcccagttacgcaaatattatgtaatttaattatcatttttatacatatactccacagggtttatttcacatagatgaactgacttaacataactcaaacgtttaacatgtataaagcaaggtgatgaaattctccctttaattttttgaataaaacttctcttcttgtttaatgtcaaacgttcaaaatattgagtgtcgtaatatttaaaactatttttccgtattagatagggttcacaatctaacatggctccaaatacttcggtgccacgataacatataacatcaactgacttatgatttgaaattaattttcgttgtatactatctatacccgcaggtgtgaatatacaatgagcatcacacttcattaagaattccgatgttgccaatgaaaaagcatagttataatattttgccaatgaccgctcaggatattttctgatttcatcattataattcttacccgccaaagcgacctgactagtatactgatagattttaatttcacatatttcctgaagttcgcttttaagacgttctactattagtaaagtatcatctgttgaattattgtctacaataattatttcacgacaaaatgcagctattgaaagaatagatagttcaataaattgagctccatttttcactctgtatatagcagaaacagatggatgtttttttcttctatcaataatactgcttagatgttttaaggttattttatctctctcatcacgacttaaatagccagctaaatgattgaaatcaaaatttatactaataaccttagactctatataatttataattttaccaagattcattcagatacaccttttttaattttttttatgatataatcatcgttacgtctttcgagcgaacagaatttttcagcaagctcctttcgatagttcatccaattgtcaatgcccttcaataggttatccatctcctggattaattcaccttgattatatactttaacccctggagttgcttcgttataactcaaataaaaatcacgcgatgcggtatatttttcaagatcaaatgggaagaagattataggtctattaagatagaggtagtcaaaatatattgaagagtaatcagttatgagaaaatcagaatttagcatactatcttcagctggttcataattatcaacaatgtgaatattttccatttcactcatatcaatatttaaagttgtattaggatgcaacctgatttgtaaatacgcgttattttttaatagaaaattattaatttcgttgaaatttaaacctgaaatacttataaaatccgagcgatcatctctccatgttggtgcatataaaaatgttttctttgtttttttaattgaattcttatcattattcactttgtgataggctcttgataagagattagatatcctaggtggatcagcaataatggcatattgcatatcatacaccctaaatgcacttttaaatgaataatcataaacaaattgactcggagcaagaatgaaattacactttttatgtttctcaggcatcaatattttaattataaatgaggctcctttaaaataattaaataaaggagatttagatatatcatattcgatttttttaagtggcgtcccatgccataaatttaccaataccgcgcctgcagatgtataaaagtttatcgttgatacataatttgaatatatatacacctttgcaatataacaaaaatatatacctttaacactatatttgtaatatgcctcataacctttacatctaattttttttatcagctttatatcatcagatatccaaatgcatcttacatcattctttttagtggtagattcaaataaatatcgactattatcagtaaaaccgctataactaccgaaaagccaaatgcttttatcccttttaattaaaaaaccgataggataaatactccacatcattaatttcattatatacttaagtattttttgcattcgaataccccgtgtaaaaacgtcgacttatatataacgttaagattgacactatcagtacagatattattggtaaacaaaaatattgataatgcaagttaagccccaaaacaaataagaatggagttaaaattgaattgattgtctgagtgataacgaacttctccactttaaaacaacgaataaaagtttcagttcctgatattataaatgtaaaggcaaaaaatattgacacataaatcatttgttctaagggcaggaccttcttaaacaagaaaaaatcaggcttaacataatagaaaatataaaatattgagtaaccagaaattaataacaaaaatgaaatgataaaatatttcttaaatactcttcttgcttcatcaatctttcccatcgcaatattgcttgcatacaatgtcatctgagaattcaaaatagatattgctatattctgtcccgctcgcataattgacatcgacataccaacgaagcctgcgatctctgcaccaagatatttaaatgatattatattaaaaccgttccagtagaaataaccaagaaaccatacgatactagtttttttcaataacggccacaactcattaaatactgttttaaatgaaaagttttttttatgtatttctatgaactggaatctacatttattaaatataaaaactgacagtaaaaaaaataatattcctaccaattgtgatagaccaagagaatatagccccaagcctaaataaattgtcagccataatgatatcgctatcattaactgactaacaatattagctttcatcaataattgttgcctttgtgttccatcaagcattgcatttaagggcaatactaataaattagtacatgaaacaaaaagcaaaaaaaaccatggtaatttccagttaactattccgttataatcattaaacataacatatgacaccccccctcccaatataaaaaaaagtattgataatattaaataccaatagattgaaaagttaaaatagttcgatatttttatatttttttcactgatatcatgaatagcataagaatggctataatactgtttcaatacgctagacatcccaacttccagcaactgtgccattgctgttaacgaaaaaaaagcataataaaatcctagttcctcagtggaaaggtttttggctagtacaagtaatgttattggccccaaaaagacacgaatagaggataaacacacggataataaagataatgttttatactttttaaagttattacatgacgtcatttgtatttgccatatatatcattttacataatattaattatacaatataaatcactatcaacaaatgagttatcattttattctccggacaatttctataatctcggtagttgatatcgatggtgttctgggcaaataaataacttcgcactcatctttaacccagtcaaatctgcccttccaatcatctcccattacaagtaaatttgcctcatactttctaatatattctaacttaagatctaaagattcttctataaagacatgatctacaaacttaagtgaggatataatctcaatgcgctcctcctggctatagattggataacgttgttttttagaaaaatttaatgaatcggatgaaactcccacaatcagcaaatcaccaaactccttcgccctttttaatatattaacatgtccaatatgaaacacgtcgaatgttccaaaggtgataactcttctcatttataattacctctgcgatcaaaaaatagtttattaaaataatattacatgatgtcattaatagtggtataacatatcggacatagtaatattttgttagatttacttatctaataaagctagtccaaattagcttttaatatcctaggcagttaatttaatcttattagaacatcatattttaaatacaaatattttctcatattaatatatgatagtgcatactgaagatatgtactgatacggcctgataatatttttaattctgtgtctaattatgctaaaaacatcttagttctgcaagaaaacgctgtgacaacttttactccaaagcataaattatattcattgaatatactataacatcatgtattatcataaccatgaggattttttgattgccaattccaagcgtctctaatcatgtcatataattctctgtttgctttccattctaatttatcatttgccttcgtgctatcagaccaacactccgcaacatcaccatcccttcgaggcataattttatatggtattttgattccagttatcttttcaaaagcttctataacttcgagtacagaatatccttttccggttcctaaattataaatttttagcccagtcgactctgaattttttgataaagcttttacatgtgcttcagcaagatcaactacatgaatataatctcgaacaccagaaccatcagacgttgggtaatcacaaccatacacttttaaataaggatactctccaatagcaacttttgtaagataaggaaataggttatttggtataccgtttggatgttcaccaatattacctgattcatgagcaccaattggattaaaatatcgtaaaattgtcacattaaaatcatcatatgcattacacaaatcagacaacattaactccatcattaattttgatgttccataaggatttgtagttttgccaataggatgagtttcatttatagggcataactttggtttaccatatacagtagcagatgaactaaagataaagctttttacgttatactctatcattgtagatattagtgataacgtttgcattacgttacttgaataatattcaatcggtttttttatagattcacttactgatttcaagcctgcaaaatgcataaccgcttttatttgatgctcattgaatatgtctaccaatatttttttattccccacatctcctttataaaagggtatgttatgatttgtcattaacttgactctctctaatgactctattgatgagttagtcaggttatccagtacaataacatcgtagccctgagaaattaacgtataaattgtgtggacacctatataaccacaacctccggtaactaaaattgacatatatggctccattaacaataaattatttttcagaaaaactcagtaaaaaaacttcaagtttaataaattaagctcaaaataactttcaattcatccaattcttttttagaataaaatcccttaaactttttacaatggaatttaagattgaaatatttagcacttggatttttatttaattcccatctgatagtcccctatcctatgtagaaataaatgagtgatttatttggcctttatcgcattaaataattaatggtgatatttttcaataataacacaattaaaaacataccgataactaattattttatttttatgtgtcatttttatacttaaaaatatcaagaacaatgctaccgcccctggctttacagctaccagagcactgcttacatgtctacgatgtgactagcgttacctactcgcgctaaactcgaaaaattcaaacgctaattgtcttaccaatccgctctggaaacaaggaaaatcctggaaaactttgactaaaatcctattgctaactcgttgttattctgattgtttatataaaacaacggcaggaatattcgcaacaaattactttcaccacgaatcttcactgccgttataattttcttatcaaccgttacatccggtcagattttcattattcgcttaacagcttctcaatccctttacggaacttcgccccttctttcaggttgcgcagtccatacttcacaaacgcctgcatatagcccatttttttaccgcagtcgtagctgtcaccagtcatcagcatggcatcaacggactgtttcttcgccagttcagcaatggcatcagtcagttggatacgtccccatgcaccaggttgagtgcgttcaagttccggccaaatatcggcagaaagcacatagcgaccaacggccatgatgtctgagtccagcgtctgcggctgatccggtttttcgataaattcaacaatgcggctgactttgccttcacgatccagcggctctttggtctgaataacggagtattcagaaaggtcacccggcatacgttttgccagcacctggctacggcccgtttcattgaaacgcgcaatcatggcagcaaggttgtagcgcagcgggtcggcactggcgtcgtcgatcacaacgtccggcagtaccacgacaaatgggttgtcaccaatggcgggtcgtgcacacaaaatggagtggcccaaacctaaaggttcgccctgacgcacgttcataatggtcacgcccggcggacagatagactgtacttccgccagcagttgacgcttcacgcgctgttcaaggagagattctaattcataagaggtgtcgaagtggttttcgaccgcgttcttggacgcatgagttaccaggaggatttctttgatccctgcagccacaatctcgtcaacaatgtactgaatcattggcttgtcgacgatcggtagcatctctttgggaatcgccttagtggcaggcaacatatgcatcccaagacctgctaccggtataactgcttttaaattcgtcattcttttcctacctctaagtggctgatagtgcgtaaattattgccataggttagccaaacgttatggctatataccaaagcttagttccgcataactttgcttaaaacttaggataacactacacaccatcagcatctgggttactcggattactcggaattccgcatactgataatttaatcagtacctctttccgaataatcgtagtccaacctggtccttttttctctgactcgtctgcattactcagaaacaaacgttatgtcgtcttttttggcatgaacgaattcatactgcagagttcgatccagaccttgcgacagcgtatacggtgccacaaaacctgaagaatgcactttcgttgcgtcaaactgtgttgttgcgcagaattttttcacgcgcactgagctgacagtgtattttttgcccgtaattttgctcaggatatcaaaacaatatccacccagcattcctagtgggtaaggcaagtgcatagaagggatctttttgttcaggctttgttcaacttcagcaaccaactggttcatgttcaggtctggcttatcaacgtagttataaacctcataacctgcggcaacattcttcagtttgtacttgataaactcaacaatgtttccaacataagccatggacttatagttagtccctgcgcccaccatcataaacttgccgccagcgatctgtttcagcaagttatagacgttaccgcggtttcgttcaccgaagatgacggtaggacggatgatggttaatgaacgttctgttggtgctttgttataccattcacgcagcacttcctctgcctgccacttacttttgccgtagtggttgaaaggatcgtgcggatggttttcgtcagggttgtgtttgttcaaaccataaacagcaacggaactggtaaagatgatatttttaacgccatttttttccatggccgccagcacattgcgggtaccctgaacgttgacatcataatagagagaagtagggctgacgtcatcgcggtgttccgctgccagtagcacaacagtgtcaaaaccggctaacgcctggtcgagtgcctgttgatcacgaacatcgccaatctgtgtgatttctggataaaagtggctctgctgtttgtccaggttcttgatattaaagtcagcaattgccgtttcaagtagtcgggttcctacgaatccggaagctcctatgagcaaaacgttatcgttcataaatcactttagtctggttgttacgtaagaaacacaagataaagatgagtaccttccctgagtagtcaatgctgcccagccccagctttaacagttagtgtgaggattataatcttttagaacattatatccagtaagtttatgaatggtcgcaaatctactccctccgttctggcaatctaaagttaatcttttccacattaacaatatggtgattaaccctgtcgatatcgacggagctttgccctctttcattcaccgcatgaacatttgcaagagatagtagtgtttcttttttcgccataaacacgccgcgaacgtctttgcgcatgtcgaagttcatgctcaatgcgggtccaactgaggattcctgcatcacattgatattacgcataaaaaggtgttgcggtttattgtgtagctcaagcgaggcacgcttcatctcaatgttagtcagcgccacaaaggagacagcattcccggcggagatttggatgccgcgcaatttataagcaaggtgggtattatccagctgaatattattcactcggaaattttgcggtatcgagagatatttgcctttaattaccccatagccgattaacatcccggcgctattaatcatttcaatattatcaatcacgaaattgtcacaaccgtaaatagcgactgtggcgttatcaatacctgctttcttactgaaatccggcgttatattgcgggctttgatattacgaataacaaaatgtttaccattttcaacatggatcaactgccgacaatccgatcccgtgatattcgccacgacaaagtttttcactgcctgatcttccgggtaattattatcataagtactccccgcaaggcctatgccaatgccccagttgatttttccgttagtacagttgatgcgctcgatgacatggtcggagatcaaaatatcacggtcgttaatcgccacgttccattcaatggcatcgccctgtaagtcgctgaacttacaattggtgatgttggcaccgattatctggttatgaaatccctggcgtaagatggcgtaattagcgtggctgacagtgaggttatcgatggtcaggttgcgcatgacccgtttgtttttgccgccgatataaatctgcgttaccgggccaaagccgctcatcgccagccctttgatggtgcagtcagagccacgcacatccagggtgatgttatgcatactgccgccctcctcccctgtcacctggctaccgtcctgtaagacaaatcgccctctgccgttgccgcgcaggcttccaaggatgtgtaacgttttgccaggaggaatgaagatgccggtgttgatattgtcgcaaaccaatccggcaggcacgacgaccgtttgcccttcgccgaaggcttgtttaaatgaggcgatccagtcgtgtgggttgtagtcgttaatgttaacgctttgtcgggcgggaagtgcgcgagcgaaaggggtatggaggaaggcaagcgcggagcttgccgtcaggaaggtgcgtcgggagagttttttaaatggcatacgttctcctctataaagcctgcaacaagctggcgagttctcggttaatcacctgctggttaaaatcgtgttcgactttttcgcgagcacgtttgataaccggagccagttcgtcggtgtccagttggctaaacgccgccagtcgttgcgccagtgcgcgagcatcattctcaggcaccagccagccggatttatcggcctccaccagttccggtattccgctatgcagagtagaaaccaccggaataccgaccgccatcgcttccattagcgccaccggaataccttccatatcgccatccgcacccgttaccgatggcaacaagaaaacatccgcgttgtcgagcatcgctttcacttcatggctcggtttaaagcccggcatctccaccacatcttccagttgatattgttcgatgagggtgcgcaggcgtctttcccacgggccaatgccgaggatgcgatagcgaaatgccacgccctgctctttcaactgacggcaggcttcaatcgccacatgcaggccttttttctcggttaagcgtgcgacggaaataatctccagcggtgttgcgggcgctttcacgggacgcgggctaaagcgcgtcatatctacgcccatgcgcgatacggcgattttttccctcgggcagcccattttttgcagccttccggcccacagatcgcttatcggtagcatcaggtcgccacgtcgaaacagttgttgatattcgggagtgtaatggttgagcacttcccgactggaaatatcaatgccgtgaaaaatagtggcaattttgccgcgaatgacacccagttcgcgtagttttgctgcggttacccccgcagggccaaaatgagcgataaagacatcggcatgaaatggtgttgcgacctgaccgcaaatggcagacaaaatcagattccgcgactcggcaccatagcgtttgaggttgagcgcctgccaggtatttttacgatgaatgccgcgtaaagtctggctggcgcggtggcgcagcttcgccactttgcccgtaggttcgtcctgtaaccaacgggttctggcggcaaggttgtatttcgtccatgccgcgtgggtgttttgtgtgtcgcctttttgcagcgcgacaatctccacctcaaatcccatatcaataaacgcggtaatttgattgaggacgaaggtttctgacgacaacggaaatttcagtaaaaagaagccgaccttcatttcacctccccgatgcgctcaagcacagattgcaccatctgcattcccgtctgacgctcacgactgacagcttcgttaagtcgtgcgttcagcgccggaagttggcctaaggtatccgcaaccatcgcttgcaggctgccgtccagtaaatgacggatatcaattgccatctccggtagtcccagctgctgcatgatcccggcggatttatgttcatagttgatggcaatcgccggagtagcaaagttcattgagataatagcggagtgcaggcgcgtaccgacggtgagttcacaggcaccgagaattttgcccatttccagatcgttgagttcatccatcactacgtggtaacgggcaggatcgctgatgtgctggcgcagattaagcgccaccatgcggtcgtctttgttatagctgtcgatgcccgtacaggtggagagcgcaatcacctgatagccttcgtcgagaatgcgattgaccaccccggcaaaggctttttcatacgcttgctgagtggtgccgagacgtttgtcgaacggtgccagttcgcgcagggtaattgccaccgttttctgttgtgcggcaacgtccagccagtgttggacggcatagctggcggtgaaatcttcggtgtggtgatcgaccagccacgcggtatcgacgccatgttcaacttttgcagtggtgatattgctgcgtttcatcagatcaaggctgaccgattcgcgcaggatcagcgcgtcacagtgaccaaaaacgtagttcgccagttggttaaattgctcatcctggaagggaccgacgctgtgaccaatcataaacagcggctttttcgccataaacgtgcaaagtgcatgttcaaactgcggcacgccatagagatcgacaaaaaacgatccgccgacctggataatggcatcgtaacctgacagcaggcgcacgaagtcagtgaatccctgggcgatggcaatattgcgcagcttgccagtgtcggtgacgcgcgagagcaatacctggtgttgatagcggcgacggaggacttttttaacgcgcccgacaacgcccgccgcgctattgtgttgtttcatttgcaggaacagcggatcgcccattaccgggcggttgagcagccaggaagaactgaccggatagcggctcatcacgtccacttcggcgtgtggattgaggatgttgatggcatcaagtaagccacgcaagatggcgctgtcgccacgattgccgcaagtgtggttgcccagaataagtaatttcattttttcctcataaatttgatgccaggtgaggctgtgtttgttttgttcgttgccgctttttgcctgatgcgacgctgacgcgtcttatcaggcctacaagacccgagcacagaaccgtaggccggataaggcgttcacgccgcatccggcattcagtgcctgatgcgacgctgacgcgtcttatcaggcctacaagtcccaagcacagaaccgtaggccggataaggcgttcacgccgcatccggcattcagtgcctgatgcgacgctgacgcgtcttatcaggcctacaggtcccgagcacagaaccgtaggatggataaggcgttttacgccgcatccggcaaccgttgtcggaaccgaaaacagcaactcaccccgcccgtaaaagcattttcattttttcgctgcgacaaaactgacgcttcacttccaccaccagcggatggcgcgacagcacaatcatcaccacaaacgccagcacgcccgcggctatttgcaccgccagcagcatccccagcgccagttgccctttcagcacaatgcccagcgcataactaaccaccagcgtcggcagcgagaggtaaaacggcagccacaaactcaggatgtactggcgataactggaaccaagaaccggtttaatcatcacgaagtaactcagaatagtgttgataatctgcaccaacaggaagccaagcgtgacgccgattgcgcccgccatctgcccaccaataacaatcgccggaataaacagaaatgttttgaatacgttgaatttaaagctgatgtcgacccgcgctttcgccatcagtagcgaaccaatcgggttacccaccgaacgcagtagccccaccacacacagcaattgcagcaccggaataatgctgttccacttctcaccaaagaccagtggtacaaagttattcgacaccaccatcagccccagcagcgccggaaagttgataatccccaccaccgacagcagtttgtagaagttcacgcgcaacttttcggtgtcgtcctgaattttggcgaatgccggaaataacacgcgggtgatgattgggttcagcttcatcggcggtacgacggccacgttgtacgccaggttgtatccccctgccacgcccgcgccaagaatacgcgccagcaccagcgttgaaaggttggtgttgagatagttgatgatgctgtccgccgtcagccaggcaccaaagcgtaagttcggtgccaccgacgccagcgagaaatgcagaccggggcgataaattttgcggccaaagtaaccaaacagcagcgttcttactgcactattgaccagataaccgaggatcgcggtcatcgccagcggccagaaatgggcgctaaccaccgtaaaagtgaagcccgccagtaccgcgctggtttcgatcatgccgattttgttgaactccagctccttctgcatcaacgcgcggaactgttgcccgtgggggatcaccacaaacgccagcgacaatgttttaatcaacggtgccaggtccgggttattcagcacgtcgccaatggcatcactcaacaaaaacaccgccacgcacaccacaagccccagcccgacgttcagccagtacagcgtggtgagttcaaggtggctgatttcttttcgctgaataatcgaattagcgataccgaagtcagaaagcgtatctgccagcgcgataatcaccagcgacacagtaagcaaaccgaactggtggttgtcgataatccgcgccagcacggtcatctgtaccagcccgaggccgatgatgatcaccgtggcaatcgccgaccacttcgcgccactgatggttttttcacgtaagctcatatcaatatgccgctttgttaacgaagcctttgaataccgtcaggaaaacgattttgatatcgaaccagacgctccattcgcggatgtactcaaggtcgaactcgacgcgtttttccattttctccagtgtgtcggtttcgccgcgccagccattaatctgcgcccagccagtaatgccaggtttcaccttatggcgcagcatgtagccttcaatgagctggcgatattgttcgttatgcgccaccgcgtgtggacgtggccccacaatcgacatccccccggtcagcacattgataaattgcggcaattcgtccagcgaggtgcggcgcagaaagttccccactttggtgacgcgcggatcgttctgcgtcgcctgagacaccactttgtcgttctccatcactttcatggaacggaacttccacactttgatcggcttgccatccatgccatagcgagtctggcggaaaataaccggcccaggtgaactgagtttcaccgccagcgcaatgcagcacagcaccggggagatcagcagcaggataagcgtcgccagcacaatgtcttccgcacgtttgagcaggcggttaaccccggaaagcggcgtgtcgtaaagcggcaccaccggaacgccgttcatctctgcaagacgtgaatggagaatgttgaaggtaaagacatcggggatcagcagcaccgaacaggtggtgtccgccaattgatggaccagttttttcactcgcgcgccgtcgcacatttgcatcgcgatatagacgttatgaatcttgcctgctttagcatcctcgaccagctgttgcaggttacccgcccagtcgttagaaacgccgcccggtttcgggtcgtggtaaacgcccaccacttcaaaccctaaccacggctgattacggaagctctccatcagcatttgtccggcggctaaatctcccgctacggcgaccatacgcttgttatagccatgattacgcagccagcccgccccaatgcgaatacatgaacggcaaaccaccagtccgatactggtcagcccataccacgccagccagattttcagttgcgtgtcgaaatcattattgaacgccaccagtccggcgctgaaaatcacgcttaaggtccagttttgtagcaacagggcaaattctgtcgctgcccgaacaccgcgccatgagcgataaaaatcggtgatgccgcccagcatctggaacaccaccagcgtaatcaacgccaccaacaggtgcatgtagaggaatgacagtccgctcacttcgcaaaccagccatagtccggcaaacatgatggtgatatctgaaaagcgttgcaccatagagattaacgatgcattggttttcgctcgctcgcgcttttttagatttgtcatcgttgttcctgttattagccccttacccgcagtggggtaagggaagatccgacattactcattcagcaacgtcagcagagttcgcgttcgcgcttccatcagcggcacatcaccgcgcgattccacattcaaccgcaccaccggttcggtgttggaggtgcgcaggttaaagcgccagtcggcaaaggtcatactgatgccatcggtacgatccaccgccagcgcctcacggctaaaatgctgttcgacgcgattaatcgcctcaacgggttgcgccagtttgctgttgatctcaccgcttgccggaaacgccgccatccggtcgcgcaccagttcgcccagcgtttttcctttcaggcacaacagttcggcgaccagcagccacgggatcatgccgctgtcgcagtaagcgaaatcacggaagtaatggtgagcgctcatttcgccaccgtagatggcgtcttccttgcgcatccgttctttaataaaggcgtgtccggttttcgacattaccggggtgccgcctgcggcagtcaccacatcaatagtgttccaggagagacgcggatcatggatgatcttcgcgccgggatttttttcgaggaacgcttctgccagcaggccgacaatgtagtagccctcgataaactgccctttttcgtcaaacagaaaacagcggtcaaaatcgccatcaaaggcaatgcccatatccgcgccgtgtttgatgaccgcattgcgggtgtcgtcgcgacattccggcagcagcgggttaggaataccgttggggaaattgccgtccggtgtgttgtgtactttgattaattccacgggcgcgccgagggctttaaagcgggcttcaatggcgtccactactggacccgctgcgccgttcccggagttaatcaccagcttgagcggcgtgaggtttttgacattgatataaccgaacaggtgatcaacgtaagcgtcacgcaggttgatttgctgatagcgaccgcgtttggtttcatcgacgggaggaaagtcgttggcttcagccagacgctggacatcgcgcagtccggtatcgccgctgatcgggcgagccccctcgcgaaccagcttcatgccgttataatccatcggattatggctggcggtaacttcaatgccgccatccacgccgagatggaacgtggcgaaatagatctcttcggtgccggacatgccgatatccagcacatcgacgcccgcatcctgtaaacctctcgccagcgccagttttaaggtttcgctggtgaggcggacatcaccgcctaacacaatggttttcggtttgagaaattcgccataagcgcgaccaatgcgccaggcaatatcttcattcagttcttcgcctaatttcccgcgaatatcataggctttaaagcaggttaattttttcatatcgttaccctttttcaggcaatagttggccctgaccgaagcggccaattttgtttttgtcgttatttacaccgcggtttcgcattcattgcctgatgcgacgctgccgcgtcttatcaggcctacaaacccgaaccgtaggtcggataaggcgttcacgccgcatccgacagccagcgcctgatgcgacgctgccgcgtcttatcaggcctacaaatccgaaccgtaggtcggataaggcgttcacgccgcatccgacaaacagcgcctgatgcgacgtttacacccgtccgtagcgatccgcgaagcgcaccacatcatcctcttcgagataagagccggagcgcacttcaattaaatcgagcggaattttccccgggttttccaggcaatgcgtcgcccccagcggaatataaatggactcgttttcaccaagcagtttgatatcaccgtcgatagtgacttttgccgttcccgcgaccaccacccagtgttccgcgcggtgatggtgcatctgtaccgacaagccttcgcccggtttcacggtgatgcgtttcacctggtagcggtcgcccgcgtcgatagagtcatatttgccccacgggcgatagacttcgcgatgtacccgatgctcatggcgaccatcggctttgatctgctcgaccacttttttcacatcctgcaccgcgttacggtcggcaatcagcactgcatctttggtctgcactaccaccagatctttcaccccgacggtggtgaccaggccagattcggcgtacacatagctgttttcggttttgtgattaatcacatcgccgtggcaaacgttgccttccgcggtgtgggtgctgatctcccataatgaagaccaggaaccgacatcgctccagcccgcatccatcggtaccacaacggcatctgccgtacgttccatgaccgcgtaatccaccgactcttccgggcaggccagaaacgcttcttcatccacgcgaataaaatcgagatccggatcgacggcgctcatcgctttttcacaggcgtcgagaatatccgggcgatattttttcagttcttcgagatagcgtccggcgcggaacaggaacataccgctgttccagtaatattcgccgcttgccacataggcctgagcggtttccagattcggtttttcgacaaactgcgccacttcaaaggccaccgtatcctgctcacccgccgacacttcaccgcgacgaatatagccataaccggtttcaggtagatccggcacaatgccgaaggtcaccagcttgcccgcttcggcatatggcatggcattacgcacggcggcacggaacgcgtcttcatcggcaatcacatgatccgccgccagcaccagcattaacgggtcgctctccgggctatgacgttttgccgccagcgccgccagcgcaatggcaggtgcagtgttacgccctgccggttcgagaataatgttctcggtgagtttgttcagttgacgcagctgttccgcgacaataaagcggtgctgctcattgcaaatcaccaccgggctttcgcactccacgccgttcaggcggcagatggtggtttgcagcatggtgagatcgcctttcaggcataaaaactgcttggggtaaagtacgcgggaaagcggccataagcggctaccggagccacctgccatcacgactggatagagtttcgactgcgccataattatccccgaatatcatttataaattgacgtaacacgttctctttatcgagcgtgcgttcggcatattcacgtgccaccgtgttgtgtttgggcagcaggagcgcctgacgaatccccgccaccagcgcctcgaccgattccggttctacgcaaaccgcaatgcccggaaaggtttcgcaaagctgccccagttctgtgtgggcttctgcggtaatcaccgcgttaccgcctaccgccagaatattggtcagtttcgacggcaatacggcatctgccgcgccgcgtttttgcaccaccagatggcaatcgcccatcttcagcagtgcgggtaaagcgtcatacgattgcagcgggaaaaattgcatgttgcgcagtccacgctgctgcgccattttttccagccgcgctttgccgccgccctgcccgacaatggcaaaaatcagcggttcatcgcgcaggagatcggcagcttcaataacgttttccagcccctgcttttcaccaatattgccggagtaaagaatgatttttttgttatccggcaggccaagctggttacgaagggcatcaacatcggcatctgcaatatgctgaaaacgggcaatttccgaccagttggggaagaagatgacgttttccgccgccacgcctttttcgatggctttattcatcatcgagcgcgaaatcgtggagacgttatcgacgttatgcagtccgctacgttcgaacgccgttgccagctgtgcaactttgccgcctttgccttttccggcaaggcccagccccagcatggcgtccacttcgtaatcctgaatatgcagcacggtacgcgcaccagagagtttcgccagcaggcgcattcccggcgtgcaaaacagcgttggcaccacgccgataatgcgatccggcttccagcgacgttgcgccatcagaggaaagaaactgctgacggcaaaactgccgagatgtaacaggcgtttcagggtgctcggctgttttggcacgtacagcgggcagcgccacaccgtggcggccccctcttctcgtttgtagcgccaggcggaatagttctcgcccacctgccactgcgggtagtaaggcggtgcggtaatgacccgcacctcatgaccttgtgctaccagccattccaccatctcgccagtgtatttgccgatgccggttaactccggcgagtagttaatgccgtagaccagtattttcataatccgggtactccggcacgcttctcagcgagaaaataggcgcggctgttagcgtgaacattgtcactggcgagcagtgcatccggcgtcagccagcggtaatcgtcatgctgctcatccggcagtaacagctcttcttccgatactctgaagcgaaaaccgagcaccacatagtgagtggtgaaatccgtgccagagaagttatcgtcataaaagtgctgccagacaccgtaaaactggcctgctgttatcggcaaacgcagccccagttccgccatcgtcagccgctcaaatgcggcttccagcgtttcgtctttctgcacgcgccctcccggcacaaaccagtaaccctgcgccgggcggttggttcttttgccaagcagaaactcgccgcgactgttctcgacaataaagtcgagagagacaagcggagtggagcgcactaccgtggcaaagtcttcctgacgtaaaaacatcattacccccgaaagcggtcttgattctcaaggaaccactggtaagtgctggcaagccccgcttccagtgagatttcgtgataccagccaagctgatgcaggcgcgtcacatccagcagtttgcgcggcgtgccatccagtttgctggcatcaaaaaccactcggcctttgtaacccaccactttggcgatggtttgcgccagttcgcggatggtgcagtcaacgcccgtgccgacgttaatgtgcgacagcatcggctgggtgttctccagccagacttcatgcgccagctccatgacatgaatgctcgccgccgccatatcatcgacgtgcaggaattcacgcatcggtgtaccgctgccccataccaccacgtccggtgcattctgtgccgtcgcctcgtggaagcgacgcagcaatgcagggatcacatgcgaattactcgggtggaagttgtcatgcgggccatacaggttggtcggcatgactgagcggtaatcgcgtccgtactggcggttgtatgattcgcacagtttgatcccggcgattttggcaatggcgtaaggctcgttggtcggctccagcgtaccctgcaataactcgctttctgccatcggctgttttgccagtttcgggtagatacaggacgatccgagaaacagcagtttgttcacgtcgttctgatgcgcggcgtgaatgatgttgctctcaatcatcatgttctgatagatgaaatccgccggatacgtgttgttggcaacaatgccgcccactttcgccgccgccagatagacctggtcaatacgttcgctggcaaagaaatcatgcacggcgcggctgtccagcaggttcagctcgtcgcgggtgcgtaataccagttccacatcaccgcgctgttcgagctgtcgcttgatggcggaaccgaccatcccgcgatggccagcgataaaaattcgttgtttactcatgcttatgactccagcgcgatcgccacgtcgtagccgtgagatttcagcagagagtgttttttcgccgcctcgaggtcattagccaccatttcagacaccatctctctgagggtgatttccggtttccagcccagtttttcgtgcgctttagtcgggtcgccgagcagcgtttcaacttcagccggacggaagtaacgcgggtcaacggcgataatcacatcccccggtttaacgcccggcgcgtcatgcccggtgacggaaaccacaatgcccttctcttcaacgcccgtgccttcaaagcgcagtttgatgcccagctgtgctgccgccatttctacgaactgacgcacggagtactgaacgccggtagcaataacgaaatcttctggctgttcctgttgcagcatcatccactgcatttttacgtagtctttggcatggccccagtcacgcagggaatccatattgccgaggtacaggcacgactccagcccctgggcgatgttggcgattgcgcgggttattttgcgggtaacgaaggtttcgccacggcgcggggattcatggttgaagagaataccgttgcaggcgtacatgccgtaggattcgcggtagttaacggtgatccagtaggcgtacagtttggcgaccgcatacggagatcgcgggtagaacggcgtggtttctttctgcggaatttcctgcaccagaccatacagttcagaggtggaagcctgatagaaacgggttttcttttccagaccgaggaagcggatcgcctcgagcaggcgcagcgtacccatcgcgtcgacgtcagcggtatattccggtgactcaaaagaaaccgcaacgtggctcattgcccccaggttgtacacttcatccggctgtacttcacgcaaaatgcgcgtcaggttggaggtatcactcaggtcgccataatgcagatggaatttcgggttgcaggtgtgcggatcctgataaatgtgatccacgcgctcggtgttgaatgacgatgcgcgacgcttaataccatgcacctcgtaacctttttccagcagaaactctgccaggtaagaaccgtcttgtccggttacaccggtgatgagagcgacttttgacatgtcttattcctctgtattttttgaatttattcagtttcaacgcgttcgcgtatcaccactgctggattcccccggcaaaccacatttgccggaagcgatttaaaaacactgcttcgcgcacccacgacggtgccgttaccgatcgtgacgcctggggcaacaaagacatcggttgccagccagcatttctcgccaatcacaataggcgtggcgttaatggtgaaatgttgacttgcatggtcgtggctcccggtgcataaataacttttttgcgatatcaccgaatgtgcgccaatggttatttcaccgagggtatataaattgacgtcatcgccgacccacgcgtaatcacctaaggttaatttccacggataggtaatttttactgacggacgaataactacgttttttcctatttttgcgccgaataaacgtaataaaaatgcccgccagcgatacaatacttgtggcgaccaggcaaatattgttgcctgtactgcccaccataattgcactttaatagcgttgccgccccggaaccctttcggcaccgagaaaccgcttaaatcttgcatcgttttcccttatattcagcttttgttatataaggctctcgtctttgaggtagtacgttggcgtaaatgccaggataattctgcccagaagccaggcacatgtaatatctgccgttggacttttttggcgtcagcacacaattccatattattggtggttgataccccacccattgaaaattcagacaccaggccattgagttttttaaatgcataaccggctttatacattttagccgccagcgcgtaatcggaagaaactttatattccaggtcataacgccattttttcaagccggacaccgggaaaaatatcgcctgatgactggcgggcagactgtggtaaatataccagccaggtttggcgctacgtttaattttatgcccgtcgccaaaatccagcagcgcatcgccggtgatcatcacgttatctttttgcatttttaacttacggacaaaatttgcggcatcctgatgaaaaatatcgcccgagttgagaaacaacgcgaacttgccttgtgccatcgcaatgcctttgttcatggcgtcgtagataccgttatctggctcgctgacaaagcgtaggttatagataccattgagattttccagatactcacgggtgccgtcattggagccgccatcgacaacaatccattcgaagctgatatcgtccgcctgcgccagatgcgccagcgaggcatgtgttttgactatcccttcgaggttacgaaacgcgacagtgattatgctaagcaacatgttcttattattacctcgtaatatttaacgcttttcgcaaaataaacggacagacgattaaaaatgcatattccgggctaaatatcgaaccggtaaaaaacagcgataccggagtaaaaagatataattgcacgcgaaaattgcggttatcaccaaaagcgttgatcatcatttttatcactttccccatgtaccacagcgataaaaacaccgcgaaccaggaaaaataaataatcagcagatacaaaccattgtctatggtttttccgacatccgcaccgttaaatattccgaatgatgcgacatattcataaagtgagccaaatctgactacaccgtcaatatgggtcaaagaataaccgaccatcaccagcggaccgacaatacgataatacgatgacgatccttccgtacctaaatcgcccagacgggtggaaatataaggaaatgcgattaccacaccaaccaggaatacagccagagaaatcaatgctaacggtaactttttcttaatcgcctctttattcagatattgaaatgcccactccagcaaataaaacaggataaaggtcataacccctgaaaacgatccggataatattatccctgcgagaatcatagcatctgttttaggcgttttgataccaaactgtttgatgctgagccaaattgagattaatgccagagcgaaaaatgccggttcgaaataaagtgctgtcgtgcgcttgccgccgaatttaatgaaattcagcacatagctgttgctgtaaatcagatatttcgaaatcgactccataatactgctgccaccggtgaggataatttgcgccatctccaccgccgccagcgccaccaccagcccgaccaccagataaaagaaacgtaatatcttgcgatggttgtgtggcgaaatcgttttaaagcgaatactccacaccatgccaataatgatcacaatatagacaaacagcatggttgaagtgacgtatttactggcatccaacgactgaccaaacaggtagttaaacgccgtgagtcccgcaccaatccctaaggcaataatcaattttttaacgctgatgcgttctaaaaacagcagtaataagacaggtaaaaaagtgacgatggtgatggggaaactttcgccaagctgggcgattttgacgttaaccagcaggtagatcagcggcagcagcaggtagctacagattctgatagaagttgacatactcctccagcatctgttgtccactgtaggcggcgcggctgcgttggctgaactcagccagcgtggtaccaaatatcgcctgcgcgatttccggtttgcttaactgcaccagttgcagcacgtcttcttcgctgacggttttaccgccggatttttgcagcacttcccgcgccgcgtcgctatgggtggcaatcaccggcacgccaatcgatagcgcctcacacaaaatcagcgggtagttatcgacgcgagaactgaacaccagcgcatccatctgattgagcgcgctcatcaacttgcgcttgtcagtttcaaagccgtgattaaccacgttgccagcggtgaacggcgagaacttaccaaaggtatgcagttcgattttatcgcccagcgccatcatctcacgcaccagttgctggttagtcttgccgtcgtaacgcaggtcatgcgccaccaccgcgattttcggcttgccctgggtttcgcgtaccggaggcaagtccgccagaatcgcttctgttgccacatcaataccattattgataatccggcaacgccctggaccgtacagactattgaaagcgtcagccacatgctggctgggggaaataaactgacagcccagtgccagcatctcgcggaataactggcgtttgcccgccaccagctggtgcgcccgatcaatcttcaccggcggatagttatttaaggtcgggcatttctggcagcccgttttccagccttcgcaaccgtcggtaaaggcgcagcgtccggtaacgctccagtgatcgtgcagcgtccagaccagagtggcgtccggtttatggtttttcaccttttcgcaaaagcgcaccacgctgttaagattcaaccagtagctgtgcagcacatgaaaatgcaggaccaccggacccggtatgcgagtaatggtgcgatataactcattgaaattgccgaacagatcgcgattaaacagacgaaacagggcaatgttcgccatcgcggtcatccgcggcgtatgtttgatgacctgcggatagttttgatggctgacgctctctttgccgcctttgccgtaaccgtagacaaaatgtgacgccagcccctgttgcagcgcacgctggtggagatctaacgccacacctgctgccccgccttccgccagtcgcacattaaattgcaaaatattcatttaattaccttcactcgcgctttttctcccaccaccagcgcgttgtccgggacagagtcgagcaccacgctgcccgcacccacggtgacgttgttaccaagcgtgatatcaccaagaataatgacgttggcaccgagttcgacgccgttgccaatgtgtggacatgccatgttatcggcaccacgattgccgatagtgacgccgtggcgaatggtgaaatcatcccccgccaccacgtttttattgatcactacggcgtaaccgtgatggatagtaaagcggcggccaatggtcgcggcggcctggatttcataaccgaaaaagcattcggtgataatgcgatacagcaccagcagcggggccgcccacagattgttgaggacgttctttttgcgccacaccgaacaaaaatgagcaacgcgataggcaagaaccatgcagcacgggcgtaaactccagctgttggcgcgcagatcttccagcatctttagcgcccccgaataccatcagccagacgtttgccgttacgcaccgacagcagcgtcagcaaagtgcgccaggtcatacgtttattgcggatctggtagagggtaaacagctgatattttttgcttgcacggtcaaatttatctttgtgcttgcggtaaaagtggaagtacccggagaattttttcggtgacgaggtgatctgcatttcaccgtgattgatatgcaggatctgcgtcgcctcttccactttccacggttcgccatactccaccaccatccgcaggaagatgtcgtaatcctgtgctgctttcagttcggtatcgaacaagcactctttgaaacgccacgcccaggtaaaaacctgattgccaatgatattgcgtttatagaacaggcggcgtgagtacggcgatttgggatacagtggtaagcttgctggttgggaataaacttctccctggcatacgtagtcgttagcgtacaaaaaggcgtgagtgaccagttgctgtttatgggcgaggaagacgctcaggcggttgggcgtccattcatcatcgtcatcgatcccggtaatgtattccccttgcgccagcataatcgcctggttacgtaccgcgcacgccccgctgttaatgtcgttgtgaatgtaggtaatacgcggatcgttgagggcagtgacgtactgttgcagttgttcccaggaggtggagcaatcatccacgatgatcatctcccagttgctgtagtcctggcgcaggaccgattttatcgcccgaatcgccagttgttggcggttccaggtcggcatatagattgaaatcagcggattgtctttcataggttgttctcccggagtgtcgagatgttctgccggtttataagcttgtttacgggttctgttgccggatgcggcgtgaaggtaggtcggataagatgcgtcagcatcgcatccgacagcggatgtcgttatttcgcatccgacagcggatgtcgttatttcgcatccgacttatattcgtattcgtaatagccataatcctgatacgcgctggcgcggcggaagatggagttcagaatcacccctttcaccggaataccgttttgctcaaagcggctcagactggtttccacttctttcaatgtgttgaccgcataacgcgccaccattaacgtggttccgacatgacgaccaacaattgcggcatcggtcactgccagaatcggcggcgtatcaatcaacaccaggtcatagtttttactcgcccagttcaccagttcggcaaagcgttcgctcatcaacagctcagaaggatttggcggcacctgaccgcgcgggatcaggtcaaatttggcaatagaggtcggtttagcagcggtagtaatatcgccctgaccaatcagaatttccgacagaccattgacgttattggtgcccaacagctcgtgggtgtagcctttgcgcatatcacagtcgatcaacaacacccgtttattggtctggctgatcaccgccgccaggttggcgcagacaaaggttttaccaattgacgggctaaccccggtcatcatcaacacattgttctgcgcctgcatcatcgcgaagtgcagactggtacgcagactacggatggcttcaatcgccagatcggttggattccccactgccagtagctggctctgtttatagcgtttaacccctttgatggttttgacgctatcgcgcgctttctgccactccgacagcgggatgctggcatagacgctgattccgtgttcttccagcacttgcgggctttcgatgccgcgattaaacaacgagcgcagcagcacacccacgatagagagcatcaggccaaggataatcgcgccgaggataatcagccctttcttcggttttagcacgccaggctgggtgattgccgggtcaacaatgcgcacatcgccgacggtgctggcttcggtgattttcagctcctgctctttattcagcagttgcatatagacctgctgaccagactcgacatcgcgggtcaggcgcacaatctcctgctgggttttcggcatcgccgttacgcgaccgttaagtttggctttctcttcttccagcgcctgacgtttctccagcagcgtgcggtacgccgggtgaactttggtgtacagcttggagatttccgcctctttaaaggtcagttcgttcaactgcgcgtcaatgttcaccatcgaatcgagcaccgctttcgcttcaagcggcagatcaacagaatctttatcctgacggaaggcattcagtttgttttcggcaacatcgaggcggctacgtacttccggtaactgttgcgcgaggaaagcgaggcttttcgacgcttccgccgatttgcgctcaatattttgttcctgatagttacgggcgatgctgttaagaatgtcgcggatctgttcgcgatcttcaccggtataagtcaggctcagtacgcctgcgtctttgccgttctccgttaccgtcaggctgttttgcagttggttgatcatccccaacgtggagtatttggtgacggtaaactcactgcccgggcgggcgtgaatggcttcaaccatcagcgtgacgccttcttttttcagcatctggcccgcttgcccacgggcgctaaagccgccatcactgctcagggtgtagtttttattgtccagcacattaagcgtaaacacctggtccgccatctctttcgggcggttaaaggtggtcactttcaccgtctcgttctgacgtcccatcaaacgatcccagcccgcaccgaaaatcgggaacgtgtttttgctcaccgcaatatcgaggtctagatcgtccaccgttttaccaagcaccagacgcgaacgaatcaactggatctcggcgtccgatgcaggcggtttgttggctaatgccgagccgatatcctgcaccagcgaattgccgctgctttgctcgatttgtaccagtgcgtcggcactataaatcggcgtggcgaagaaggtgtaaaccacggcacagagggcaaatacggcggtgatgccaatcacccaccagcgcgcttcaatgacggtgccgatcaggcgaccaatatcgatttcatcactgcccgttaccggagcggcatgttgttttactttttctgtcattcttatacctgctctgcgttcaatgcctgcgcccactggcgggcagaccgttcaagtaatgtgtacaccgctgcaaacgtttcccggcttttgcgatacggatcggggatttcacattcgttatcccagtgaccaaacagcatcactttgccgcgcatctcaggtgccatctcgcataagcgttcgatatggcgcttttccatagtcaaaatcaggtcatagttgcgacacagacggcggctgatttgccgtgcacagtgaccttccagagacagttgatgttctgcggcgacgctgatagcggtaggatcagcgcccttaccgaccagcgcgccgagtccagcggactccactttcagttccgggtgataacgttgcagtaagcgttccgccgtcggggaacggcaaatattgccgacacagacaactaagatgttgttaaacatgacgattaccagttatgaatgtcgctggctgtatccgtcatgtaacggacaccgctaatagttggcagcaactgattgatcagacggttccagcgggaaaccggggcggtggtgacatacaccacgtcataaggttgcaggcggaattctgtcgccatcaccagcgacgtcgcatcggacatatccagctggtagatattggcaatcttgccattacgcccgccctcgcctttcagcggacgaatgacaaagatgccgctggcgttggaggtggtcatgtcgatgccttcagcattacccagggcttcagtcagggtcatgccgctaaagtccattttcagggtgctctgtttcttcacttcacccatcacaaatactttcagatcatcattacgcggcacgtagagaatatcgccgggataaagcagtcggttctgattgaggtcgccgttttgcatcagcgcctgcaaagaaatgcgttcttcacgaccattgtgtgttagcaccacgttgcgccagtcagcggtgtcggtcaggccacctgcggcgttgatggcgtcgagaatagtcagtggtacgttggtgatcgcctgttgaccggatttattcacctgacctgagatataggccttttgtgagcggaaggcggcgatattaacgtccacctgcgggtcagcgatgtacgtcgctaagcgcccggtaatatcactgcggatttcagcgagcgttttcccgactacgtgaaccttgccgatatacgggtagaacatggtgccgtcaggctgtacccagttgccggtgtcactggagctgcggtactgaccggctggcgtggtgagttccgggtgatcccagacggtgacattaagaacgtcccccggcccgacgcgatactggtaattcgcgatctcgctttccagcgtcatattggggcgcgctacgttgggtcgtggacgtaattggtcaatcaggcgcggggtcaacggataaacattcaccattttgtcgagatcgaaatcagcgtcctgctgtttgatgacgtctttgcccatcgtcgacatattgctgcccggaagtactgtgcaaccgcttatcaaggttactgacaccaataatggcatcaatttcattttggatttcatcattgtttatttatcactttggcagagtaattatcctgtgcactattaatagcaatgtcgccatgcacatttaccttgcagttaattgaatacaaatttaactggcatcagtcctaaaaaaattgatttcatccgcaggctattgacagaataattcagactggtctttcaggcatccagacacgctaccgcccctggctttttagctaccaatacactgatttagcttaatttttcaaaccctctctgcatacaatcgttgatgagaaagggttattgcggaaattaacttccgattataaggtgacattatggtaattgaatattggctctccaataatgcaggaggaagtgttacagctaacggaatagcaggcaaggtaacaattcggcaattggctatttttaagaattatattaagtgtcattcaatatggtttttaggagtttctttaggttgacaatatttaatattgcgcctccacatgcgatatttcttaaataatgttttattattaccacttttaattcagggataatgtgaggttattaccctcaaataatatgagataaatagtgctgcaacattgcatttttgccccgatttatccatgatcgaattgtgacatttgtcatacaacgaataggttttgtacttactatggaatggattgccgatccgtctatctgggccgggttaatcacgctgattgtgatcgaactggtcctcggcattgataacctggtctttattgccatcctcgccgaaaaactaccgccgaagcagcgcgaccgcgcacgggttaccgggctgctgctggcgatgttaatgcgcctgttactgctggcgtcaatctcctggctggtcaccctgactcaaccgctgttcagcttccgctcgtttacctttagcgcccgcgacttaatcatgctgtttggtggtttcttcctgttgttcaaagccacgatggagctgaacgaacggctggaagggaaagacagcaataatcccacacaacgcaaaggtgcgaagttctggggcgtggtgacgcaaattgtggtactggacgccattttctcactcgactcagtgattaccgccgtcgggatggtcgaccatttactggtcatgatggccgccgtggttatcgctatcagcctgatgttgatggccagcaagccgttaacgcaatttgttaacagtcacccgacgatcgttattctctgcttaagcttcctgttgatgattggctttagcctggtggcagaaggtttcggcttcgtcattccgaaaggctacctgtacgctgccattggtttctcggtgatgatcgaggcgctcaatcagttggctatctttaaccggcgacgttttctttccgctaaccagacactgcgccagcggactaccgaagcggtaatgcgcctgcttagcgggcaaaaagaagatgcggaactggacgccgaaaccgcgtccatgctggtggatcatggtaaccagcagatctttaatccgcaggaacggcggatgattgagcgggtacttaatcttaaccagcgtactgtcagcagcattatgacgtcgcgccacgatattgagcatatcgatctcaacgcgccggaagacgagatccgccagttgctggagcgaaatcagcatacgcggctggtggttaccgacggtgatgacgcagaagatttgctcggtgttgttcacgttatcgacctgctacaacagtcactgcgtggcgaaccgctcaacctgcgggtgttgattcgccagccgctggtgttcccggaaaccttgccgttgttacctgccctggagcagttccgtaatgcccgcacgcactttgcttttgtggtggatgagtttggctcggtggaagggattgtgacattaagtgacgtcactgaaaccattgccggtaacttaccgaacgaagtggaagagatcgacgcccgccatgatattcagaagaatgcggacggttcctggacggcgaatggtcatatgccgctggaagatctggtgcaatatgtgccgctgccgctggatgaaaaacgtgaatatcacaccattgccgggctgttgatggaatatttacagcgtattccaaaacctggcgaagaagttcaggtgggggattatttgcttaaaacgttgcaggtggaaagccatcgcgtgcagaaggtgcagattattccgctgcataaggatggcgagttggagtacgaggtgtgatggtatcggtcattttacccgatagccgaaaggaataagatgagggaaccgcgccagcggcgatttaccgccgggagcccgggttgccagggtggtggcgattgagccaccctggcacgttcaccggcttgagcgttccatagtagtgaggaacatcaagtgaacggaacagccttcgatcttacatattcagaatataatggtgccgccgcgaacgcctgatgcgacgctttacgcgtcttatcaggcctacaggacaggtcacctggtaacctacatcttctccagcaacttcttcacatctttgccattgcgggaatctttattccgctcggcccagtcattcaggcgacgtttcgcttcgtcctgtagatgtttgcgcagtaactgatccacttgcagactgtaattgagttgctgccagttgccataaacccgcagcggtactggcgtttctttgaggaaatcaatcagtttgctttccccgttccagccacccacgacccgaatatcaaactgggtgtcgcaggtttgatctgccagattcaacatgccttcccctgtcagcgccagcacaggcgattgaccttgcatgtcgtttaacgtcacgacgccatccttcaacgtcaaatcggtggtaaagcggtcaagacgcgttacgttatcgaagttttcagcggccttcacatcaccaccattacgttctaccgcttgctgaatcatctgctggaagttcatcccttccatgcgcgtgtcggtcatttcgacatgtgcctgtccttgccagttgtggcggaatgcgtcggcatctatgtcagcaccggagaaatcaccagccagtgacatttttccggtcaacgaaatcggatagttaaacgccttcagaatggtaccaatctcaacgttttccagccgtggctggaagtttatccgcggatttactgatgtcgcgtccagcgtgcccggcagtgaaacctgtccaccgttaagtttgccctgcaactggataatctccagcaaacccgacttgttggtcatttgcgtggcaacatctgtaaaattcattccgcgccagcgcacgttactggcctgcaacaaaatatcagccgtaaagccttgcagtccctgatatgccggttcatcaatacgcgaagaaatgaccgggcgcggcaatgttgattggctctgcccctgctgcgcggcaccgttttcaccattcgctgtttcattaagcgggatgaggttgtcaagattcagttgcgggaattgcagtctcagctgccattcaggtttctctgtcagcgtgacctgtgcttgcccgctcagcgtgctgtcattggcggtcaagctgatttggttaaatgaaaggcgtttatgtgactcctgccactgggcctggaaactcccctgcccctgaataccttgttttggtaaatctgcaccctgcaactgccagttaatttgttcaatagccgccgttaaatcatgcggataatcagaagcatctaccgtaccgttaagggatatcgtgagatcgcgctgatcgcgattaacccgcccggagaactcaaatgaaccacgatgttggggatcttgttccatttgcaggcgaatattgcggattgtcacctgctcgtcatcttcatgctggaacaccagcacgctgtccgccaccttaagactggatatatcaaacgaccatccgcgatcgtctgacagatccggcaaggtattgtcgcgcggtgcaaccggagcgtcttcactgcgcaccgcttccgtctgcggcgtcagttgaatcactgccccttttagcatcacctgcttaacgctcagttgatgactcagtagtggtaaaagcgccacgtccagacgcatgttgtcggcgcgaaccagtggctggcttgcgccctgggcggtgagagacattcgcccggagaggatactaagctgcggccagacgtgccaacgcagtggcccgtcgagctgcaattgataaccgctacgtgcagcaacttgcttgaccatatagtcgcggaaatcattcggattcaccagcaacactaacgcagataacccggccaccagcacgaccaggagtatcatcagcgtcgtcagaaatcgtctcatggtatcctcaatgggcctgaattagtctttatcgattcggctggctaccgcgccctgctgattgcgatatttcgcatcttcacggcggttgtaaggtcgcgccgccgggccggaaagcggctcaaagctcagcgcaccaattaacatgcccggacgcagcgccagcggcagcttaccggagttgtagaactccagcacaatgcaaccagaccagcccggatcgatacggtgcgcggtgacgtgcaccatcagccccagacgcgccagtgaggaacgcccgtccagccagcccaccagatcggctggcagcgtcaccgactccagcgtcaccgccagcgccagctctcctgggtgaagatagaacgcctcgccctcgtcgagaacgatctcatcgctcatcacgcggtcaagcgcggcgctcacttcatctttgggaccgctcagatcgataaacgctgccgtgtgaccacggaaggtacgaaatttattgcccaggcgtacatccaccgtcgcgccgttaatacgctccactggcggacgtgggttgatcgacaaacggccttcatcaagccaggcttcaatatctcggtcacacagacgcatggcattttctcctttcgcgcatcactcccttaacgccaattacgtcaagggcataccaggttatcactgaacggtacacaatttatcaagcttattcaaagaactgacttattttcgctttcaatatatcgatcgcgatgcggtttttcccgccgcgcggcacgataatgtccgcatattgtttagaaggctcaatgaattgcaggaacatcgggcgcacggttttttgatattgcgccatcacggaatccattgaacgcccacgctcgttaacgtcacgcttgatgcggcgcatcaggcagatatccagcggggtatcaacgaaaatggagaagttaagttcgtcacgcaaacgcgcatccgtcagcaacaaaatgccttcgagaatgatgaccttcttcggctcaaccgtcaccgtttctttcatacgcgtatgttcaacatagctgtaaaccggcaggtcaattgccgagccgcgtttcaacgcttgtaaatgctcaagcaacaggctgtgatccatcgcgctgggatggtcgtagttggtcttaacgcgttcttccatcgacagatggctttgatctttgtaatagcagtcttcgggaattacgccgatgtgttcatcaccgacttgctcacgtaattcacgataaagggtactggcaataagactcttgccggaagccgatgcgccagcgataccgataatgacgcactgatgagactgatcagtcatatatttagcgacctgattaacctggatgttaggaagggggcgacgaagcgccaaacgcggcaattatagggatttcatccgtctgataccagtcgaatagcgttgccgcgcgctcagagttaattgttgacaaagaattcccggtggcaaattacgttgatcagttttatgtaaggtaaaaaatgttatacgcagttgcgcaaattatccgcctttacgtcactttatgagcaattcgcatataaaatgtaaaacttttgtactagcataaacacagaaacgaatactggcgacctggtcttgcggataaagcggtaatgagcaaacaatcacagcatgtattaattgccctgccccacccgctgcttcacctggtcagtttaggtttagtctcgtttatctttacccttttctcgcttgagctttcgcagtttggcacccaactcgccccactgtggttcccgacgtccatcatgatggtggcgttttatcgccatgccgggcgcatgtggccgggaattgcgctgagctgttcgctgggaaatatcgccgcatccatcctgcttttttccaccagctcgctgaacatgacctggacgaccatcaatattgttgaagccgtggtcggggcagtgctgctacgtaaattgctgccgtggtataaccccttgcaaaatctggctgactggctgcgtctggcactcggcagcgccattgttccgcctctgttggggggtgttctggttgtcctgctgacgcccggagacgatcctctcagggcatttttgatatgggtactgtcagaatccatcggcgctctggcactggtgccgctgggattgttatttaaaccacactatctgctgcgccatcgcaacccacggttgctttttgagtcgctgctcacgttagccatcacactgacgttaagctggctttcgatgctgtatctgccgtggccttttactttcattattgtgctgttgatgtggagcgccgtgcgtctgccacgaatggaagcctttttgatcttccttaccacggtgatgatggtgtcgctgatgatggccgcggatccctccctgcttgctacgccgcgtacgtacctgatgagccatatgccgtggctaccgtttttgctgatcctgctgcccgccaacatcatgaccatggtgatgtatgcctttcgtgcggaacgcaaacacatttccgaaagcgaaacccactttcggaacgcgatggaatattccgctatcggtatggcgttagtgggcaccgagggacaatggctgcaaaccaacaaagcgctctgccagtttctcgggtacagtcaggaagagctgcgcggactcacctttcagcaactgacctggccggaggatctcaataaagatctccaacaggttgaaaagctgataagcggtgaaataaacacctattcaatggaaaaacgctactacaaccgcaatggcgatgttgtctgggcgttgcttgccgtctcactggtgcgccacacggatggcacgccgctctattttatcgctcagattgaagacattaacgagctaaaacgcaccgaacaggtcaatcagcaactgatggagcgcatcactctggctaacgaagcgggcgggattggcatctgggagtgggagttgaagccgaatatttttagctgggataagcggatgttcgagctgtatgaaattcctccacatatcaaaccgaactggcaggtgtggtacgagtgcgtgctgccggaagatcgccagcatgccgaaaaagtgattcgtgattcgttgcaatcacgctcgccctttaaactggaatttcgcattaccgtaaaagacggtattcgccatatccgcgccctcgccaaccgggtactgaataaagaaggcgaagtcgaacgtctcctcggcatcaatatggatatgaccgaagtgaaacagcttaacgaggcattgtttcaggaaaaagagcgcctgcacattacgcttgattccatcggtgaagccgtggtctgtattgatatggcgatgaaaattacctttatgaatccagtggcggagaagatgagcggctggacgcaggaagaagcgttaggtgttccgctcctgacggtgttgcatattacttttggcgacaacggaccattaatggagaacatttacagtgccgacacctcacgttccgcgatcgagcaagatgtggtgttgcactgtcggagcggcggcagttacgacgtgcattacagtattacgccgttaagtactctggacggcagcaatattggttcggttctggtgattcaggacgttaccgaatcacgcaaaatgctgcgccagctgagctacagcgcctcccatgatgcactgacgcatctcgccaaccgcgccagttttgagaaacaactgcgtatcctgctgcaaacggtaaacagtacacatcagcgacatgccctggtgtttatcgatcttgatcgctttaaagcggtgaatgacagcgccgggcatgcggcgggtgacgctttgctgcgcgaactggcgtcgttaatgctgagtatgctgcgttccagcgacgtgctggcgcgactcggtggggatgaatttggtctgctgctaccagactgtaatgttgaaagcgcgcgttttatcgctacacgcattatcagtgccgtgaatgactatcactttatatgggaaggccgtgtgcatcgggtaggtgccagtgccgggattaccttgattgatgacaacaatcatcaggcggcagaagtgatgtcgcaggctgatatcgcctgttatgcctccaaaaatggtggccggggccgggtgacggtttacgaaccgcagcaagctgccgcacatagcgaacgggcggcgatgtcgcttgatgaacagtggcggatgattaaagagaatcagttgatgatgctcgcccacggtgtcgcttcgccacggatcccggaagcgcgtaatttgtggctgatttcacttaagctctggagttgcgaaggcgagattattgatgaacaaacatttcgtcgtagcttcagcgatccggcacttagccatgctcttgaccgacgggtattccacgaatttttccagcaggccgcaaaagcggttgccagtaaaggcataagcatcgccctccccctttccgttgccggtttgagtagcgccacgctggtgaatgatctgcttgagcagctggataatagccctctaccaccacggttattacatctgattattccggcagaagcgattttagatcacgcagaaagcgtgcaaaaactgcggctggcgggatgtcggatagtgctcagccaggtgggccgcgatctgcaaatcttcaactcgctgaaagcgaatatggcagattacctgctacttgatggtgagttatgcgccaacgtgcagggtaatttgatggatgagatgctgattacgattattcaggggcacgctcagcgactcggggtgaagactatagccgggccagtcgttttacccttagtgatggatacgctttcgggcatcggcgtcgatctgatttatggtgatgtgattgccgatgcccaaccgctggatttgctggtgaatagtagttatttcgcgattaactgagggagcgtttgcccattgcctgatgcgacgctaacgcgtcttatcaggcctacaaatctacaaatcgctcattctccaggccggataaggcgctcgcaccgcatccggcgaccaacgtcatgcttcgtctggttgccagccttccgtataccagatatgcaacagcgcataagagcgccagggcttccagcgttcggcataacggcggatttgtgctggtgtcattcccggaaatcgctgtttaatcagataatcatccggcaggaaaacatctttcgcctgccagccacgcaaagcgaaataattcgccgtccagcgcccgatacccggaaaagtttgcagcgttttcatcgcttgttctacgtcgcccggtattgtcattggtaaggtgccctccagcgccgcatttgccagatgaatcagtgcctctgcccgtttcaacggcatgcctaacgcttttaatgcctgcgggtctgctgctgccagccgctgaggcgtggggaagcagatatactccggaaaatcatccagccgttcgccataaagctgtgccactttggcggtcaattttgccgccatcgccacgctcaccagttggcctaaaatggcacgcacgccctgttcaaaagcatcaacacagccgggtaaacgcaatccgggccgcgccgcgcctaacttgcccaacgcaccgttaacaatctgcgggttacattgcagatcaagcaggcggctcattttcgccatacactcagcggcaacgggttctaaacctgcacttaaatttatgtgcagagtatggcgggctatatccggaatagcagtcaccacgccgcgatattcgcccaccgccagactacgggcataataactgtccgcgacagtttccacaccactcaccgcacgggcggcgagaaatcccaacatccacgaccagtcatacggcggctgccagttcagggtatacatcgcatctccttgttaatccgctttcagcataaacgttattcagacgctacgctttgctttcatattccggttgtcgcgacggcaacatttcgctaaagtcacgccccttcttcaccggcatggggattatttcgtgtttattggttttgattacggtacagcaaactgttcagtggcggtcatgcgtgacggtaaaccgcacttgctaaaaatggaaaacgacagcacgctgctgccttcaatgctttgcgcgccaacgcgtgaagcggtaagcgaatggctgtaccgccatcatgatgttccggcagacgacgatgaaacgcaggcgctgttgcgtcgggcgattcgttataaccgcgaagaagatatcgatgttacggcgaaaagcgtgcagttcggtctttcctcactggcacagtacattgatgatccagaagaagtgtggtttgtgaaatcaccaaaatcgttcctcggtgccagcggcttaaaaccgcagcaggtagcgctgtttgaggatctggtctgcgcaatgatgttgcacattcgccaacaggcgcaggctcaactgccggaggcaattactcaggcagtgattggtcgcccgatcaacttccaggggcttggcggcgatgaagcaaacgcccaggcgcaagggattctggaacgcgcggcgaagcgtgccggattcagggacgtggtattccagtacgagccggtcgcggctgggctggattacgaagccaccttgcaggaagaaaaacgggtgctggtggtggatatcggcggtggtacgactgactgttcattgctgctgatggggccgcagtggcgttcgcgtctcgatcgtgaagccagcctgctgggtcacagtggttgccgtattggcggtaacgatctggacatcgcactggcgtttaaaaacctgatgccgttactgggcatgggtggcgaaaccgaaaaaggcatcgccctgccgattctgccgtggtggaatgcggttgccatcaacgacgtacctgcgcagagtgatttctacagtagtgccaacggtcgtctgcttaacgatctggtacgcgatgcccgcgaaccggaaaaagtggccctgctacagaaagtctggcgtcagcgtttaagctatcgcctggtgcgtagcgcagaagagagcaaaattgctctttccagcactgcggaaacccgcgcctcactgccgtttattagcgatgaactggctacgctgattagccagcaagggctggaaagcgccctcagccagccactggcgcggattctggaacaggtgcaactggccctggataacgcccaggaaaaaccggacgttatatacctgaccggcggtagcgcccgttcgccgctgattaaaaaagcgctggcagaacagttgccgggcattccgattgcaggcggcgatgactttggctccgtcaccgccgggctggcacgctgggcggaagtggtgtttcgttaattgaaaaatggctcagcagcggcttaaatctgcctgcgcctgagccagtttttctgccgcctgacgtaacggttccatcaacggcatggtccgtgctggcgcatgaaggcggaatcgctgcaactctgtcgcgccgacagtcaacgtcgattccagccgatgtcgtttggcggccattttagtcattaccgcttgtctgtctgcaggcgttaccgcttcgttcggcctgaacacaaaacggcgttcacagctcgctttccagtcgataaccgcctgggtcagatggtcgccaaaccctttcacttgcttaacgccacgacgggtaacatctgctgctgtttcaataccaaaggaccgtaacgccgctttacgcgcagggccaacaccgggaatagaggcaacatcaataaaaaatctctccagaaacttctgtttctgccgttcccttgcagtgtcatgaagtgctgccagagcgcgtttctcttcttccggtaacccgagaattttgtccttcattttttcgagcatcgcccgtttggcgataaaaccttccagcccgcccaactgttggatctggttgactaaatggtcatagtccattttcgcgcgattaaatacctcacgacgttgctgaacttctgctttgtacgctttgcttgtcagactgccaataatccagatagccgccagcacaggaaccaaaataatataacgcggttctgcctgaaggccgcaaagcaacagcgataacgctgacagtgcgatctcaatcagaatgatgtattcgcgccgtaacaggcctaaaggaagcggcctgccagtcggttggaaatgatcgggtaatggcagttgcaatgctggcggcgctactgacgccatcaccatcgcccagactttcgccagcacaaaatcaccgctggtggtaatgacctcttcgccgagatcaataaaatagataacgccttgattatccagcgcacaccacgggcagtcagtcaaatgagcggggtaaacatgcattgctgaaacggtacatttctttaactgttggcgtagagagtccagtgccgctacccacgctttagccgtcggacgccccgttgccacgccactttccgtgaatgcctgctgaaacatggcttcaacatcgcccggtaacatcgacagcggaatcgatcgtggcggcggttttaaaccacgtcgctgattatctgacgcgtaggcataacggaaatgggcaatatccgtctccagcgcattacccgcatcagagataagcggcacaccagaataaggatgccgcccaccaaacaagacgtgaaaaatcagcaacgcaaggccaaaattatcgtgattcgcggtacgttcaaaaccgacaaatgacgacaaggtttgtagctctggcggcgtaaaatgcgacacgccgacttcgcataaatgcagtgtgccattggcgttaatctgaaaggagtcactatcgatcaacaccactttgctgtcgcgacctaccataaagctgttctggtttacgtcccccacgacgtgcccgtgctcgtgaaccgtagcaaaagatgaagcaatattgcgcgcaacatagagtagaaaatcccacgcacaatgagggtaactctggcgacgatgtgccgggctatagatcatatgaatcggttctttaccagaaacttttggcatcataaaaccgataacttttccgcctcgtccaccgtgaagcgttgcctgcggccaggcgacataattcaacaactgcgcgtcagctgtcgcagccataaaggcaagtttgtcctgttttaaggcgggtggcggcgtgtgataaatcttggcgacgctatcgacaaactcctcgatatcataaaccgcgccttcaccacctttgcccagttcacggccaagagtggtcaattcacctgtcgatgtaaatacttttatatttgttttcataatatttcgcgggtagttatattatatttcaatgaataataacaactaaccattaaaattatttctatatggggaaaacccactcaagaataaaaatgataatgcaattttatcaggatacaattcaatttcggcctgataatgattaacttccacaggtttttgctaactttgactacaaagggattctggagaaaaaatgaaaaagatattacttatgttgagtctgctattttttactaccgcgggctttagtgaagtttcggatacgttagtgacgggaggttatgataaacaagcgatgtctgacgcgattaaacatgcgcggaaagaaaccgataaattcatcgaggttatgaataaaaaagatgccgatactttcgcagtcaaagccccgataaccgatcacggaagaaccgagcatttctggcttacggatgtcacttattctaacggcatgtttattggcgtaatcagcaatgaccctggtattgttacaaacgtagaatatggccaggagtggaaaatcaagaaagaagatatttcagactggatgtatacgcgcggggataaaatttacggcggttataccattgatcctttattggtcacctatccaaaagaagaagccgacgagctaagagcaaaattagttcgctaatcagccgttatatttattgtttaaactggcggttgaattgttgtcttcaaccgccatgagaaactcactctgcccacagcgccagtgccaacgttttatcatcatccgtacgctcgtttaccgccgggctggacaaaaactgctttaacaattcaggtaataaatcgagttgttcctgcgttgctgacgccagtccattgaaaaacggggtaaagaaaggcacatgcggagaattatccagcatatttaacgccagtcgctgaataccatccgtaaatgctgcaactttgtgcgcacgctcagtgctggtgaaagtttccagtctggaaacggcatcttcatcggtaatgaagtgcgtcatattggtatattcacccaccatcggcgtgagcggcagttgcaaaccgtgccccaaatctaccaccacgccgccatcgccaatctgcataatcaaggtgccattagctgatgaaatcaatcccaaaaacgtgcaggcaaaatcgcgaaccgctaattctttggcttccgcctcggcaaaaagtcgctgacgaatggtcagcacaatgtccgttgcgaggacatcattaagccccaattccccgccctgcactttttgcgacatataagccatcgcttcattgacggcgagcatcgcaccttcgccaccctgcgagacgctgcctgcgccatcagcgacaaataccgacaataatggctgctggtcatttagccaggcaacctgcatctggcaggcatcctggcaaggcaaatcagcgctgatgtgcgacgttccaacggctgatgcatagaccagacgccagctcacactgacgtccagccttttggcgcttccagcacaacttccgttcccggcgtggagcgggaaaccgaacgcagcgaactggataaccagctaaacagttcacggaattgtaatccctgcagagacaaaggctgacggacgctgatttgggccagcgtcttcatatccgccccctgaacaccgatggaaaagaaggcaaacttcttatcttcttccccctgaaacactttgttggcggcagcctgccactcatcggttggtgcgccatcggtgatcaggaaaatccacggacgataataggaaataccattggcacgatattcacgtttccgctcctcaaccatatccagggctttggtaatggcagcgcccattggtgtatcgccctgggcaaacaggatgggcgggaaaaaattagcggcgctggtaaagggttgttccacatgcaccgggccgaacgtcacaatgccgagttccactctttttaaggccagcgaatcggcaagcagctcatcgcgaaaggtaaccaatccggcgttaagttcattaatgggtctaccgttcatagaaccagaaacatccagcagcaaaatgcaggggcaacgtggttctgggttactggcaaaatcgctggtggcaaacgtgatttgttcgctcataagaaatcctttcttagagaattattgaggtccggtatcataccgattgcaataatgaaataagagcaaacgaagaaactttcagaattaggcccggcggcgcagaaaattttgctattcgcctcgcaagaacggagagccgtcgattgacactaaggacggagtgacataatttcaggagtgagggttagggagaggtttccccctccccctggtgttcttagtaagcctggaagctaatcactaagagtatcaccagtatgatgacgtgcttcatcataaccctttccttattaaaagccctcttctccgggagaggctttcccgtttcagcgtcccgctgaaatcatcggcttacctcctttcgccctgaatgcagtctatcgctaacgcgtgaataaaatagtttcctctgtgattattgcgtaacgactcgcaaagaatatttgctggcaggatcgcagactacaaagcctgcggattgacaatcttatcgtgaaggcatactttcaggagtgagggtagagcggggtttcccccgccctggtagtcttagtaagcggggaagcttatgactaagagcaccacgatgatgagtagcttcatcatgaccctttccttatttaaggccccttcctcgggaggggctttcccgtttcagcatccggctgaaatctgcggcttacctcctttcgccatgcaagcagtctatcgctaacgcgtagataaaatagtttcctgtgttattactggatgcgtgctcgcaaatgtgcccgtcattcagacgattccagacagtgtttcataattcctccatttttctcccttattggctggctacactagtatcattccgcgaaacgtttcaggaagagaaactcttaacgatgaaaggcagttataaatcccgttgggtaatcgtaatcgtggtggttatcgccgccatcgccgcattctggttctggcaaggccgcaatgactcccggagtgcagccccaggggcgacgaaacaagcgcagcaatcgccagcgagtggtcgccgtggtatgcgttccggcccattagccccggttcaggcggcgaccgcagtagaacaggctgttccgcgttacctcaccgggcttggcaccattaccgccgctaatactgttacggtgcgcagccgcgtggacggtcaactgatggcgttacatttccaggaaggccagcaggtcaaagcaggcgatttactggcagaaattgacccaagccagttcaaagttgcattagcacaagcccagggccaactggcaaaagataaagccacgctcgccaacgcccgccgtgacctggcgcgttatcaacaactggcaaaaaccaatctcgtatctcgtcaggaactggatgcccaacaagcgctggtcagtgaaaccgaaggtaccattaaggctgatgaagcaagcgtcgccagcgcgcaattgcaactcgactggagccgtatcaccgcaccagttgatggtcgcgttggtctcaagcaggttgatgttggtaaccaaatctccagtggcgacaccaccgggattgtggtgatcacccaaacacatcctatcgatctggtctttactctgccggaaagcgatatcgccaccgttgtacaggcacaaaaagccggaaaaccgctggtggtagaagcctgggatcgcaccaactcgaagaagttaagtgaaggcacgctgttaagccttgataaccaaatcgatgccactaccggtacgattaaagtgaaagcacgctttaataatcaggatgatgcgctgtttcccaatcagtttgttaacgcgcgcatgttagtcgacaccgaacaaaacgccgtggtgatccccaccgccgctctgcaaatgggcaacgaaggccattttgtctgggtactgaatagcgaaaacaaagtcagcaaacatctggtgacaccgggcattcaggacagtcagaaagtggtgatccgcgcaggtatttctgcgggcgatcgcgtggtgacagacggcattgatcgcctgaccgaaggggcgaaagtggaagtggtggaagcccagagcgccaccactccagaagagaaagccaccagccgcgaatacgcgaaaaaaggagcacgctcctgatgcaggtgttacccccgagcagcacaggcggcccgtctcgcctgtttattatgcgtcctgtcgccaccacgctgctgatggtggcgatcttactcgccgggattatcggttatcgcgccctgcccgtttcggcgctgccggaagtggactatccgaccattcaggtagtcacgctttacccaggtgcaagcccggatgtcatgacctctgccgttaccgcgccgctcgagcgccagttcgggcagatgtctggcctgaaacagatgtcgtcgcaaagttccggcggtgcgtcagttatcaccttacagttccagctaacattaccgctcgatgtcgccgagcaggaagtgcaggccgcgattaacgccgccactaacctgctaccgagcgatctgcctaacccgccggtttacagcaaagtgaacccggcagatccgccgatcatgacgctcgccgtcacctcaaccgccatgccgatgacgcaagtggaagatatggtggaaacccgcgtcgcgcagaaaatctcgcagatttccggcgtcggcctggtgacgctttccggcggtcagcgtccggctgttcgcgtcaaacttaacgctcaggcgattgccgccctcggcctgaccagcgaaaccgtgcgcaccgccattaccggcgctaacgttaactcggcaaaaggtagcctcgacggcccttcccgtgcggtcacgctttccgcgaacgaccagatgcaatccgccgaagagtatcgccagctaatcatcgcctaccagaacggcgcaccaattcgtcttggcgatgtcgctactgtagagcaaggagcagaaaacagctggctcggcgcgtgggcgaacaaagaacaggccattgtgatgaatgttcagcgccagcccggtgctaacattatctccaccgccgacagcatccggcagatgctaccacagctcaccgagagtctgccgaaatcggtgaaggtgacggtactttctgaccgtaccaccaatatccgcgcatcggtcgacgatacccagtttgagctgatgatggctatcgcgctggtagtcatgattatctacctgtttttgcgcaatattccggcgaccatcattcccggcgtcgcagtgccgctgtcgttaatcggcaccttcgcggtcatggtgtttctcgatttttcaatcaataacctgacgctgatggcactaaccatcgccaccggatttgtggtcgatgacgccatcgtggtgatcgagaacatttcccgctatatcgaaaaaggcgaaaaaccgttggcggcggcgctcaaaggcgcgggtgaaatcggctttaccattatctcgctgaccttctcgctgattgcggtgttgatccccctgctgtttatgggcgatatcgtcgggcgactgttccgcgaatttgctattaccctggcagtcgcgattttgatctcggcggtggtgtcgctgaccctgacaccgatgatgtgcgcgcggatgctcagccaggagtcgctgcgtaaacagaaccgcttctcccgtgcctcggagaaaatgttcgacaggataatcgccgcctatggtcgtggactggcgaaagtgctgaatcatccgtggctgaccttaagcgtggcgctcagcacgctgctgcttagcgtgctgctgtgggtattcattccgaaaggtttcttcccggtgcaggacaacggcattattcagggcactttgcaggcaccgcaatccagctcctttgcgaatatggcccagcggcaacgccaggtcgcggacgtgattttgcaggatccggcagtgcaaagtttgacctcatttgttggcgttgatggcactaacccgtcgctgaacagtgcgcgtttacagatcaatctcaaaccactggatgaacgagatgaccgggtgcaaaaagtcatcgcccgtctgcaaacggcggtggataaagtgccgggcgtcgatctcttcctgcaaccaacgcaggacctgactattgatactcaggtcagccgcacccagtaccagtttaccttgcaggccacgtcactggatgcgctcagtacctgggtgccacagttgatggaaaaactccagcagctgccacagctttctgatgtctccagcgactggcaggacaaagggctggtggcgtatgtcaatgtcgacagggacagcgccagccgcctggggatcagcatggcggatgtcgataacgccctgtacaacgcgtttggtcagcgactgatttccactatttatactcaggctaaccagtatcgcgtggtactggaacacaacaccgaaaataccccaggcctcgcggcgctggataccattcgcctgaccagcagcgacggtggcgtggtgccgttaagctcaattgccaaaattgagccgcgttttgcgccgctttccatcaaccatctggatcagttcccggtaacgactatctcctttaacgtgccggataactattcgctgggcgatgcggtgcaggcgattatggacacagagaagacgctgaatctgccggtggatatcaccacgcagttccagggcagcaccctcgccttccagtcggcgctgggcagcacggtctggctgattgtcgcggcggtggtggcgatgtatatcgtgctcggcattctgtacgagagctttattcacccgatcaccattctctcgacgctacccaccgcaggggtcggcgcgctgctggcgttaatgattgccggtagcgaactggatgtgattgccattatcggcattattttgctgatcggtatcgtgaagaagaacgccatcatgatgatcgacttcgcgctggctgctgagcgcgagcaaggcatgtcgccgcgcgaagctatttaccaggcttgtctgttgcgttttcgtccgatcctgatgaccactctggcggctctgcttggtgcgctgccgctgatgttgagtaccggggtcggcgcggaactgcgtcgtccgttaggtatcggcatggtcggcggtctgattgtcagccaggtgctgacgctgtttaccacgccggtgatttatctgctgttcgaccgtctggcattgtggaccaaaagccgctttgcccgtcatgaagaggaggcgtaagtgaagttttttgccctcttcatttaccgcccggtggcgacgattttactgtcggtcgccattaccctgtgcggcatactgggtttccgtatgctgccagtcgccccgctgccgcaggtcgattttccggtgatcatggtcagcgcctcgctgcccggtgcgtcaccagaaacaatggcgtcttccgttgccacgccgctggagcgctcacttgggcgcattgccggagtcagcgaaatgacctccagcagttcgctcggcagcacgcgcattattttgcagtttgattttgaccgggatatcaacggcgcagcgcgcgatgtgcaggcggcgatcaacgccgcgcaaagtctgctacccagcgggatgcccagccgtccgacctatcgcaaagcgaacccgtcggatgcgccaattatgatcctcacgctgacatccgatacttattcgcagggtgaactgtacgatttcgcctcgacacagctggctccgacgatttcgcaaatcgacggtgtcggtgatgtcgatgttggcggcagctcgctgcccgccgtacgcgtcgggctgaacccgcaagcgctgtttaatcagggcgtgtcgctggacgatgtgcgcaccgccatcagcaatgccaacgtgcgtaaaccgcagggggcgctggaagatgatactcaccgctggcagatccagactaacgatgaactgaaaaccgccgctgaatatcagccgctgattattcattacaacaacggcggcgcggttcgtctgggcgatgtggcgacggtgaccgactcagtacaggatgtacgtaacgccgggatgaccaacgccaaaccggccattttgctgatgatccgcaagctgccggaagccaatattatccagacggtagacagcatccgcgcccgtctgccggaattacaatccaccattccggcggcgattgatctgcaaattgcccaggatcgctcccctactatccgcgcgtcgctggaagaggttgagcagacgctggtaatctcagttgcactggtgattctggtggtgtttttgttcctgcgttcaggtcgcgccaccattattcccgccgttgcggtgccggtttcgctgattggtacgtttgcggcgatgtacctgtgtggtttcagtctcaataatctttcgttaatggcgctcaccatcgccactggctttgtggtggatgacgccatcgtggtgctggaaaacattgcccgtcatctggaagcggggatgaaaccgctacaggccgcgctacaaggtactcgcgaagtcggctttacggtgctgtcgatgagtctgtcactggtggcggtgttcctgccgctgctgttgatgggcggattgccgggtcgcctgttacgcgagtttgccgtgacgctttctgtcgccattggtatttcgctgctggtttccctgacgttaacgccgatgatgtgcggctggatgctaaaagccagcaagccgcgcgagcaaaagcgactgcgtggctttggtcgcatgttggttgctctgcaacaaggctacggcaagtcgctaaaatgggtgctcaatcatacccgtctggtgggcgcggtgctgcttggcaccattgcgctgaatatctggctgtatatctcgatcccgaaaaccttcttcccggagcaggacaccggcgtactgatgggcgggatacaggctgaccagagtatttcgtttcaggcgatgcgcggtaagttgcaggacttcatgaaaattatccgtgacgagccggcggtggataatgtcactggctttaccggcggttcacgggtgaacagtggaatgatgtttatcacccttaaaccacgcggcgagcggagcgaaacggcccaacagattatcgatcgcttgcgtaaaaaactggcgaaagaaccgggagcgaatctgttcctgatggcggtacaggatattcgcgttggcggacgtcaggctaacgccagctaccagtacacattattgtccgacgatctggcggcactgcgcgaatgggagccaaaaatccgcaaaaaactggcgacattgccagagctggctgatgttaactccgatcaggaagataatggcgcggagatgaaccttatttacgatcgcgacaccatggcgcgattgggaattgacgtgcaagccgccaacagcctgttaaataacgccttcggtcagcggcaaatctcgaccatttaccagccgatgaaccagtacaaagtggtgatggaagtggatccgcgctatacccaggacatcagtgcactggaaaaaatgttcgttatcaataacgaaggaaaagcgatcccgctgtcgtatttcgctaaatggcaaccggcgaacgctccactgtcggtgaatcatcagggattatcggcggcctcgaccatttcgttcaacctgccgaccgggaaatcgctctcggacgccagtgcggcgatcgatcgcgcaatgacccagcttggagtgccttcgacggtgcgcggcagttttgccggaacagcgcaagtgttccaggagacgatgaactcacaggtgatcctgattatcgccgccatcgccacggtatatatcgtactgggtatcctttacgagagttatgtgcatccactgacgattctctccaccctaccctcggcgggcgtcggagcgctgttggcgctggagctgttcaatgccccgttcagcctaattgcgctgatagggatcatgttattaatcggcatcgtgaagaaaaacgccattatgatggtcgattttgcgcttgaagcccaacggcacggtaacctgacgccgcaggaagctattttccaggcctgtctgctgcgttttcgcccgatcatgatgactaccctggcggcgctgtttggtgcgctaccgctggtattgtcgggcggtgacggctcggagttgcgccaaccattggggatcaccattgtcggcggtctggtcatgagccagcttctgacgctgtataccacgccggtggtgtatctctttttcgaccgtctgcgactgcgtttttcgcgtaaacctaaacaagcggtaaccgagtaaatgacagatcttcccgacagcacccgctggcaattgtggattgtggctttcggcttctttatgcagtcgctggacaccaccatcgttaacaccgcgcttccctcaatggcgcaaagcctcggggaaagtccgttgcatatgcacatggtcattgtctcttatgtactgaccgtggcggtgatgctgcccgccagcggctggctggcggacaaagtcggcgtgcgcaatattttctttaccgccatcgtgctgtttactctcggttcactgttttgcgcgctttccggcacgctgaacgaactgttgctggcacgcgcgttacagggcgttggcggcgcgatgatggtgccggtcggcaggttgacggtgatgaaaatcgtaccgcgcgagcaatatatggcggcgatgacctttgtcacgctgcccggtcagatcgggccgctgcttggcccggcgctcggcggtctgctggtggagtacgcatcgtggcactggatctttttgatcaacattccggtggggattattggcgcgatcgccacactgatgttaatgccgaactacaccatgcagacgcggcgctttgatctctccggctttctgttgctggcggttggcatggcggtcttaaccctggcgctggacggcagtaaaggtacaggtttctcgccgctggcgattgctggcctggtcgcagttggcgtggtagcactggtgctttatctgctgcacgcccaaaataacaaccgcgccctgttcagtctgaaactgttccgcactcgtaccttttcgctgggcctggcggggagctttgccggacgtattggcagtggcatgttgccctttatgacaccggttttcctgcaaattggtctcggtttctcgccgtttcatgccggactgatgatgatcccgatggtactcggcagcatgggaatgaagcgaattgtggtacaggtagtgaatcgctttggttatcgttgggtactggtggcgaccacgctgggcctgtcgctggtcaccctgttgtttatgactaccgctctgctgggctggtactacgttttgccgttcgtcctgtttttacaaggaatggtcaactcgacgcgtttctcctccatgaacaccctgacgctgaaagatctcccggacaacctggcgagcagcggcaacagtttactgtcgatgattatgcaattgtcgatgagtattggcgtcaccatcgccgggctgttgctggggctttttggttcgcagcatgtcagcgtcgacagcggcaccacacaaaccgtctttatgtacacctggcttagcatggcgtttatcatcgcccttccggcgtttgtctttgccagagtgccgagcgatacgcatcaaaatgtggctatttcacggcgaaaaaggagcgcgcaatgaagttctggcgacccggtattaccggcaaactgtttctggcgattttcgccacctgcattgtcttattgatcacgatgcactgggcggtacgtatcagttttgagcgcggctttatcgattacatcaagcatggtaatgaacaacggctgcaaatgctcggcgatgcgcttggtgagcagtacgcccagcacgggaactggcgcttcctgcgtaataacgatcgctttgtatttcagatcctacgttcactggagcatgataacaacgaagataagcccggccccggtatgccaccacacggctggcgcacgcaattttgggtggttgatcaaaataataaagtgctggttggcccgcgagcaccggttccacccgacggcacacggcggcccattatggtcaatggtgcggaagttggcgcggtgatcgcctcccctgttgaacgactgacccgtaatactgatatcaattttgacagacaacagcggcaaaccagttggctgattgtggctttatctaccttattagcggcgctggcgacattcccactggcgcgcggtttgctggctccggtaaaacgactggtggatggcacgcacaaactggcagcgggtgatttcactactcgcgtagcccccaccagcgaagatgagttgggcagactggcagaggatttcaatcaactcgccagcacactggagaaaaaccagcagatgcgccgcgattttatggccgatatttctcatgaactgcgcacgcctttagcagtactgcgcggcgaactggaagccattcaggatggtgtgcgtaaattcacgccggagacgctggcttctttacaggcagaagtcggaacactgacaaaactggttgacgatctccatcaattgtctatgtctgatgaaggcgctctcgcctatcaaaaagcaccggtagatttgatcccactgctggaagtggcgggaggcgcatttcgcgaacgattcgccagccgtggcctgaaattgcaattttccctgccagacagtattaccgtatttggcgatcgcgatcgtttaatgcagttgttcaataacttactggaaaacagcctgcgctacactgacagcggcggcagcctgaaaatctctgccgaacagcacgacaaaacggtgcgcctgacctttgccgacagtgcgccgggtgtcagtgacgatcagctacaaaaattgtttgaacgtttttatcgcaccgaaggttcccgcaaccgcgccagcggtggttccgggctggggctggcgatttgcctgaacattgttgaagcacataacggccgcattattgccgcccattcgccttttggcgggcttagcattacagtagagttaccgctggaacgggatttacagagagaagtatgaccgagttaccaatcgacgaaaacacaccgcgtattttgatcgtggaagatgaaccgaagctggggcagttgctcattgattatctgcgtgctgcgagctatgcgccaacgttgattagccacggcgatcaggtactgccatatgtgcgccagacaccaccggatctgatcctgttggatctgatgctccctggcaccgatggcctgacgctgtgccgggaaattcgtcgtttttctgacattccgatcgtgatggtgacggcaaaaatcgaagagatcgaccgcctgctggggttggagattggcgcagatgactatatctgcaagccgtacagcccacgggaagtggtagcgcgcgtcaaaaccattttgcgccgttgcaaaccgcagcgtgagttgcagcaacaggatgctgaaagcccgttgattatcgacgaaggtcgttttcaggcttcctggcgcggtaaaatgcttgacctgacgcctgcagaatttcgtctgctgaaaacgctctctcatgaaccaggaaaagtgttctcccgcgagcagttgctgaaccatctttatgacgactaccgcgtggtaaccgaccgtaccatcgacagccacattaaaaacctgcgccgcaagctggaatctctcgacgccgaacagtcatttatccgcgccgtttacggcgtcggttaccgctgggaagccgacgcctgccgcatcgtttaacatttttacctgccggagatggccttcagaccagatccggcaacattatcccacgcatggtcagcaaactgacattatctctccgccctggcaggcaccagaaaatcgctcatactttaattggcaaacagtacctttagatgctgttttcgatacgcaatttcaatcaaggagtcattatggctggttggtttgaactcagtaagagcagtgataatcagttccggtttgtgctaaaagcgggcaatggtgagactatcctcaccagcgagctgtatacctcaaaagcctctgcggaaaagggcatcgcgtcggtgcgtagcaacagcccgcaagaagaacgctatgagaaaaaaacggcaagcaatggcaaattctatttcaatctgaaagccgccaatcatcaaattatcggctccagccagatgtatgccaccgcgcaatctcgtgaaaccggaattgcctccgttaaagtaaatggcacaagccagacggtgaaagacaatacgtaattacgatgccgggcgtaggttgttggcgtccggctttatatcaaaataacgcttatttattgataattaagattaacctccgtcattaaaataatgagtaaataagtttcagtatcagaatttatcacgccccacaatcaccaatctgatccaccaccgtcagataccagtcactgtcataactgtaaagttgacttaaataaaataccagtccatcgttactctcttctggcgcagcgaccacacgcacggccccgtattccattcgacgcgctgcggcaatctgcgcatcagaaatagtattttgcggtgaaccaaacatctgcgtgaagaccaaactacggctgactttatggtgaacatcgctattgctaataaaatacccctgcttattccagccacgttcgcagttaaatttcgggatagctttcttattaaattcgtcatctcgcggaacatgttcccctgccgagggccatgggaaatactcgggaacaggttgcctgaaattaatttgcttaagattttcaacatccatcgaagcaccacggtggaaaagaacatacaaacccgtttttttatcaattaacgagttgattaattgggcatcttcttgctgaaagcccataatcacctttctggctgtttcctccagcgtacacccggcattggcgggtaaagaaaagaatatcagccccaccagcatcattcctttttttaacatcagcattgtttgcatcttctcatcatggggctcatattacacatttaacaattttcaggataaaccttacaccatactgttaacctggccgggtaattcgctagctggaatacgaaaggtataccaggcataacgacagcgtttccacaggctggagaaatggagatgataaaggcaatctgcaataatttcgttatctggatataaagactcggcaaaatgtgtccagcgcgcactgagtttcatgttaaacagtttttcatcttctttgttaccatacaggcgcgacaaagtaatcattgcttcgagcgtacctttattcgcttcttcttgtacctgttggaggtgcaaatgagcaagtgagagttctttcacctcaaagatattaagtaaaaaaagcccccatgctttttcatgtccagcttcatgagccagaaataaattgtcaaggagatttttttcataaatagcccgtgtttctttagaaatttcttgtttatttagtgcctggtagcagatagcaatgctaaaataaatattttgtagatcttgttgatgttcgctataaccataattttttaccagtggataagataccgagctatggaaatttaggtcatcttgaagtattttaagtgcccgtcgaaaatactccaaagctgtagatggttcataaggtaattttgtattgtcttccttatccaaatattcaagagcaactaaatttaatgcggcaggaatatttctttgcttaccaattgtcgcaagcggaatgaaataatcagaaaggtcaaaccaactcaaatcttttattgccgaccgccaattatgattgtatttaatgtcactagctttttccagccaagcatcgccctgcccttcatctttttcaaaacccaaaataccctctcgctggaaaaaccccctataaataacaggtgtagcataagttgtattctgtgaattttggcagataaaattatatatccagaatgaatctggataataacttaatgcaaattttatcgcgtacgcagtgtaataattattgagcttcatgtcttccatcaccgctcgctgtatacagcaccacaacttatcgtgatcgttctgcttgttatagcaggcaagtaaccactctagggcattatggcgacattcctgaaattgtgcgtactgagcaatattctctgctaagtcgattgcatattgttgctcctcgggcgcaatgtcctcaatgctgacatctcggtaatcatcccaccaaagtaagagatccatatagtcatgttcttcggtagataagtgcttacaggttactgaatccagcaattcggaaatttctttatgcgaccctccccagcgtagcattcgaaatggtatatattcaacaaaaggataaaaagtgtgaggaaaaatagtcaggcaaacagaaagccaatatttttgcccaccatcatcatcatactcaggaagtatattggggcgaggcaaaacggggcatattgcatgctcaaacgaaagtccggaatacgccatcaacgcttccacttcttgcggggagcggcggtgataatttttcagtgcgatcattaatggtattcctgcgacactatcaccgttaaggtgtgccgccagccaggctggctgaccaaatacttttgagttggtgctggtaagtaatgcagccatccattgtcgtgggtcacaatcaattgctttaagtgtagcgatgaccatttgttcattacatgcaccagcacaaagccacattgcatgtgtggtatcatttgcccagccataactgcgatataaccatgcacggtgattccagtattgtgcttcggcaagccaggcatgtgtagaatgaggtcttgcttgctgccaggttttaatgagtcttaaaccttctgttccggcatcaactagcgtgttcatatcataaaaatagttgcacatttgggtccaggataaaaaatagcgcttttcagcctgacgagaagtgaaactctcctgtaatacctggttataaatttcatctagttcctgataacgtttttcttgtaacatataaggaatatttgcgatttgccattttctctcaagagtattaagtggcattttttggtcacacatcttttgcattgcactgagtaaacgagcatcctgttccatagatatccttttaattaggttcaaaaattttaaattcattccacggcaattttttccagttactggatggatctttcaaccatgcagtgacttcctttaaatcacggttcgcagtggcgacgggggtatcgtatatcattaaccatttttgtcgggcgcgaacataagcactggcataatcttcccatgaagcgaaacaatcttgtgctctttgagcattcagtaataacactatccaggcctggttttcatcgcaccagcctaaaccggcgatgcaacgagttaaaaaagcagtgcgcatacagtcaaacgccagcccatccagaacctggccttgtgctgccagttgttcgtaaaaatcatgtggagaattaccaagccctgtagcccagcgctgtaatataacgccaatttgttgacggaaatcttcgttgctttggtaagtttctgttcctagctcttgtttaacctgtagtgcaagttgttgacgcttatcatcagtcaactttaaatctaacgtgaagccatttactgacagtccattacgacgagcaactatatcaccaattgctaatgcccacttacgtctctttgttgctcgtcttttgtccttgattagatccttttctttttctttagcaataaaagcatcgatttgtggtttgttttttttgtatctatagataaaaataaatattgcgaccaggagaacaatgataagactcattatttttcaacctctgacaggggtaagtaatgagatgtctgtaatgtcaaactctctatctcaaaggaaatgttgctgatattttgacctgcaaattgcggatgccactcagcgccagggaataacatttccgcagaagtagcaactatagggtcaatagcattaagataatgtaacttatcaggtgcgctgtgtaacagtaaccactgcaactccactgaaggatttgtaaaatgttctaataaatgaaagttattatgtagtacgcttagtaaaaaactggtttcgtatacttccgttacatatttccacccctgatattcaggtgtattttcataaacaatacccataccttcacaatcactatgtcgaactgcttgtggtgataatagttgcaaaagagacaaaacatcgtccgcatattttttaactggatgacgattttgcttaccttttatttgatcaatttcaagtgaatcaccaacaacattgagagcaatagtaacatgaggaatattattattatcacgcaaactgaataaccgtaatttatgttgctcaatttgatttgcataatactcaccataaccaccggtaagattttttcgatcatcaaactggcctacgcaatgttgcatatgccatgattcataagccatttcacgacgaaggttcgaatgactggcatcaaactcaacaatttttccgtctggcacatcaagtattgactttacagtattttgttcactcggctgccaccctttctcgcgtcgttgaagcatcttttcatgctcttcttcacgcattctgaacgcaacgtagcaggttatgcgctgtagttttgattccagacgggtaccacatttcctggaaagaaattccaccaactcccgttctttggttaatatttgttgatgatcggtttcgatataataaagtgtcgcagttgatactgaggcagtattaaacttcgataccagccattccgggattacatcatcatttttattaaacagtgaatattctgcaagcgagttaatttgttgcaccattggaaagtcactaattagccatcgataaaaatggttgagtaaccatttttggatggtctcattatcctggcgaaacagacttctttgcaaaattgctgtttttacttccggggcattaattacatcccttgcattataattctggtgaatatttccagtcataacatccgcccgtgtttattatatcactcaaagcaataattgttgactatagattttttatctaaatcagcatggttgcaggtacatactcaagtaagccactcaagaaaataacgtaaactcaatagtggcagcgtcacaaactttggaaattatgtcttatatttgcagtttattttagtgaataattgagataaatgacattattttacatcctcaataattcaggctgtaagaggacggcaaatacattcataattatcaggggatgaacattcaggaaagtagtcagtatcgtcaactttttcttttatcactacatgaagatttcgtgtagatactcccatctctgccacttctcccctcacatttacactggagctaaacccgccgattgcgctacaatgcccgcccttaaagtgggggcactcccctaaccgcttcatcaggtgaagcggctctgacctgtcatcagaacgagagaattatgtttaaaccggaactcctttccccggcgggaacgctgaaaaatatgcgttacgctttcgcttatggcgcagatgctgtttatgcgggccagccgcgttactccctgcgtgtacgcaacaacgaattcaaccacgaaaatcttcagctcggcatcaatgaagcccacgcgctggggaaaaagttttatgtcgtggtcaacattgcaccgcacaacgccaagctgaaaacctttatccgtgacctgaaaccggtggtggaaatggggccggatgcgctgattatgtccgatccagggctgattatgctggtgcgtgagcacttcccggaaatgccaatccacctctcggtacaggctaacgccgtaaactgggcgacggtgaaattctggcagcaaatgggtctgacccgcgtgatcctctctcgcgaactgtcactggaagagattgaagagatccgcaatcaggtgccggatatggagatcgaaatcttcgttcacggcgcgctgtgcatggcctactccggtcgctgcctgctctctggctatatcaacaagcgcgacccgaaccagggcacctgcaccaacgcctgccgctgggagtataacgtccaggaagggaaagaagatgacgtcggcaacatcgtacacaagtacgagccgattccggtgcaaaatgttgagccgacgctgggtatcggcgcgccaaccgacaaagtgtttatgatcgaagaagcccagcgtccgggcgagtatatgaccgcgtttgaagatgagcacggcacttacatcatgaactcgaaagatctgcgcgccatcgcccatgttgaacgcctgaccaaaatgggcgtgcattcgctgaaaatcgaaggccgtaccaaatctttctactattgcgcacgcaccgcgcaggtttaccgtaaagctatcgatgacgccgctgcgggcaaaccgttcgataccagcctgctggaaactctggaaggtctggcgcatcgtggctataccgaaggtttcctgcgtcgtcatacccacgacgattatcagaactacgaatacggttattcggtttctgaccgtcagcagtttgttggtgagtttaccggtgagcgcaagggggagctcgcggcggtagcggtgaaaaataaattctccgttggcgacagccttgagctgatgacgccgcaaggcaacattaactttacccttgagcatatggaaaacgccaaaggtgaagcgatgccggtcgcaccaggcgatggttatactgtgtggctcccggtgccgcaggatcttgagctaaattacgcgctgctgatgcgtaatttctccggggaaaccacgcgtaacccccacggtaagtgattaatttcgattatttttcccggatggaaaattcttagaaaccgatcacatacagctgcatttattaaggttatcatccgtttcgctgaaaaacataacccataaaatgctagctgtaccaggaaccacctccttagcctgtgtaatctcccttacacgggcttattttttacgcgtaatacaatgaaataaaaggatttatttctggtcacgtccacacattgaccacatcgacaaaaaagcccctcgactgaggggctttctgtttgtaattacatccacataatttgctgccctgacggcaacgggtgcggccttacggcgtggacttctcccggcttcacgatgtatctctgtaccgactcataagtgatgaacgtggcgctgcaattcacgttctggcactggtgataacgctcttttgtcgtgtcagtgatatagcggcttgtacgcgcatgtgcggcatgctggcataaaggacaatgaaacatcgcgagcacctcttccggttttgttaatggtgccattttatttaatttatccttataaaacaaacagataaaacaaaacattaatcatcatcttctgtttcgtactccacatcagaaagcctgacctcaagctctaaggacgtcgtgaagccgctattattcagaaaatgtgtcaccttagtgattgtccagtcctgctcgtctatgacgcgcttaaagcctgacactctgaccggtgtttccgtgtaaatatcagcacgaccagtggcaaggctgatggagaactccgcaacgccccgttgcagtttatcccacttcgcctgagcggcgcgcatggcctgcgctttcgtggcatataccgtggtcagggcaaaaacgttgtcagcttcaccggccatgtattcaccttcgcgcgcttccggtacttttggcgctttcttctgcgtgactggtttcgctttcgggtgctccagtgcgcgcaggtgtttctctttctttttgcgtttcagttttaccttctgcttttgcggcttcgggtctttggtgtgtaaccactttgccgttacgccggtataggctccacggtcagcaatcgcaaaatgatggcggtcgccgtcgctgcgggttatggtgacctgcgggatttttttaccgctggccgtcaccccctgccccgctttgagaaacaacagttttcccatttttaccgacacctcaccgccgttgcgttctgcaagacgggtcaggaatttcgcatcagactcctgcgactggtcgatgtgcgggattttaattccggccagtgacggcgcgacactggcttccagcctgttacgggaggctatcgcctcaacaatcgcaccgagcgtggtgtcatgccatgacccttcacggcgggaattgagcgtcccgcgaaaatctgcactccgggcgcggatggtgaccacatccggtgcgccccggtgttcaacctcatcaacggtaaatttccctttgcataccagggcaaaacctttccagccgatatacaccttcagaacagcaccacgaaccggcagttcgacctgcccgtcggcatcgttcagttcaatatcaagctggtcagcctcaaagccccggttatccgtcagggtcatgctcatcagacggtcgctgatattgccggtaatatccctgctgtcgagcatcagcatgtaatccggcgtcagcgtactgcctgcatcaaatgtcagcgcatccagcattatcccgcccccgtcatacccgtgaatctggtcgccacactgccagccttaccgatgagcgattccgcctgtttaccgatatcgccataaagcgcggccagtgattcatccacgcgggtgagcgacagcgtaaaatcaattttccggggtgtgccgtctgcaaagaaaatactccctgtttcactcaccctgctgatgacatacatgccgtaaatcatgccggtgccatccagcaacggccacgcccggccttcctctgccatcagcctgagcgtggtcatcgtcagcttcccgccggtcagttcgggataaagcacgccggcaagcgtcatgttttcctcacccacaccgagaaactgaaaggcatcccgtttaccgatacgggaatttgacggccagcgataatctgattcacgctgcatggtctggtgtggcagcgtctggcgcataaaaacaaacatacctaacgcgagcatcatttttcgtcacctccttaaccgtcatgcatcatgctggcacgggcacgcgcacgtttatcccgctcgtatttttcgagcgcatcctgtaactggcggtcaagctgtgtccccggcgcagtaccacccgtcaggctgatgtgatattcgtttttactctggtccacataagagcggccagccagtgccgtgactggctgataagcctgatagcctgcataagagctggtcgccggaatataaccaccggtgccatacgtggcggcatgagttctggcggcggtctggtcaagtgtgtctgactctttgttgatgaccccgagcttttccagtacccaggcaataccgctgcgcagtttgttgaacgcattaagcggcagcatcagcgcgtcagccagtgcctgcccgaacatgacacccgtgtcacggcaacggttcagggtgtcctgggtggctttgaccggggcaatcaggtttttaaaccactgccacgcggcctgtaacttttcgcccagccagtcaaacaccggcttaagtggcatgaacagttcccccaccggcgcaaatgccgctttcagcccttccaccacaccgccaaagaatgcgctgacaggctcccagtatttacggataagcaacgccccggcgacaatggcggccaccacggccacaaccggccagctaatcgccccgatggccgtcataacagcactgccaaccgtcgtgaagattgcccccattgcgcctgctgccgcgataatggcattgatgccggtgataaccggccaggctacaagaccaatggcaccgatgatgccagtcagcgccagtgcgccaccggcaatgaggccggtggttgacgccagtgatttgtttttctggatccagccgtcgagttttagcacatactttgtggctgtctgcgtgagattacgcagtgcgccttcctgctggtcaaacaggtcagtccccaccgcctcataagcggactgaaactccttaaagtcaccgccgaggttgtcctgcatgatatttaccagctcggcggtcttcccgtctgaggctttaaacgcagcggtcagtttgtccagctttccggttgaggcggcagtcatcagcacggcggcggctgagctggcctcttccccgaaaatagttttcatgtattcagcctgctgggcagtaccgagccggtttttctcaaaactggcctgcatttctttcagaatggtaaatactggtcgggtgtttcccttgctgtctgaggttttcacaccaagctctttcagtgcatcccacgcttttcccgtcggtgcctgcaggcggcttaacacggcacggcttcccgtccccgccattgagcctgtgatttttgcatcatgcagcgccccgaccattgcggcggtttcttcaatgctgacaccggcattttttgccacaggtgcggcataggtcagcgcatcgctcatgccgtcaaaatcggcggcggttttgttcatcgtcatggagagaacatccccgatatgagcgaccttatcgtttgaaagctgaaaggcggatttcatccccatcagcagggcggcgttttcttccatcgtgcgacggttcgccagcgccatattcagcgtgaccggcgttgccgcctgaatggcatcaacatccccaccggcttttgcaatgataatctgcgcaccggctgcatcatccgccgaggcggcggtgttgtcgccgagctggcgcgcctgtttgcggagcgcggccatttcggcggagtcttttgccacgccgagcacagcctgtaattctgagtttttctgcgcaaactcataaccgggcatcagcagcttaactccggccatcgttcccgccgccgcaatccccacaccggcagcgcccactgaggccatatttccggccagttcctttccggcctgataacgctgtttgactgcgttaagttttgcctgttgcgcgctgacacgcgccagcgcgtcacgctgccggttaagctgcgcggtggtttcactgatacggtttttcagcccctgctcatcatgtgcaagattgcgggtattaattcccacagcagccagttcccgctgctggcgtttaacggaatccgtcaggcggttatatttcgcctgtaagtcctccgccgctcgctttgcggattccagcactttcgcctgagcacgggtcggacgttcggtatttttaaactgtgtggcaagggcttcggcttccagccgtgccttctcaagtgcatgaccagtcacggcgagctgtgcgctggtcttgcgaaatccctcaatacgggatgcgtgaccgttcagctcgcgcagtgatttttgtgtgtcccggatatcccccgacagcgacttgctcgctgtacggatggatttaaacgggcgggatgcctggtcaacagccctgagcaatacctgtaattttacattgttactcattcgtgtttccgcttcgccggagcgccttttcgcgccatgtgatgagttcggtcaggctcatgggatacagttctgatggcggccagtgaaatatcactgccacatccgccatcaggtcatcgaccgacagatttttcggaaacgtcactgcaccgagttcggcgacaaaaaaccgaccaccttaccggccagcgccacaaggtcaggcagttccagcgcggcgacttcctgctcggtcagcatcggtgccgtcatgcgcggcagcaccttaatcagtgcatcgacttcggagtttgcaaccgcagccagactgacaccgcgcagcgtcccggcattgggtttcatcagcgtgacctgttcgataacctgctcaccacgtttgaccggattttccagggtaatgacattttctttgttcatggttttctcacttctgaatcagggttaaccggtcagcctggctgaccgtatgaaaatcacaggccgatatttcggcggtgttgctccagccggtcgacgccgttcaccttctcaatcatgttgatggtgtcgatttcgaccagctccttaccgtccatcgtcagccggaaataagtacaaatcaccgggagtttcgattcggtatcctctccctgtttaccctctccggtgtcgacttctttctgacgcccacgcatgaccacttcgacggccaccgtttcgccggtatcgtcgcgctggtaagaaccagcaaaacgaatcggtacggcatcagcactggttgcagcgtaaagctcccagataaccgaatccgggaaacccccgagcgaccactccattgacagcgcatcgtcatcaaggccgaggtctaccggtgcgctgccgttcatccccgcaccgcgataattttcgagcttacgggtcagttttggcagcgtgacggacgttgcaacgccctgatagctgtagccgttcagaaagacattcatgtatttgagtttgcgcggcattgccatcggtcaggctccttaattgctgttaaccgaggtgaccagatttgccaggtatttatcggtaatacgctggcgcagggtcaggttttcgagaggaggcaccggggtatagtcgtagtcgatatacagttttccggccttgagggtttccgcatcgttggattcttcgctgaaccagcaggtcgcatccacgatatagccgtttgttttcagctctcggaatttggcattgatgccgtcaacgatgtcgcgaatcagcgttgcggtgatgggcttgtccaccgcccacatgtgcgcctcagccatcgtgtcggccagcacctgcgcggtgcgggtgtagttttcaaagaggaacagcgggtcatcagagcaggtacggttaccccagaagcggaaaccgtcacggcgaatcagcgttgtgacgcctgactcgttaagcaggtcagcatcggtgccggactcctgcaaatcccagaatacggacgcgctgatgccggtaacaccgtttaccccgacgttggacagcgttttatgccagccctgctcctggtcgattttagcgcgcagacccagcgcacgggcggtggcatacgcggtggcggtggtactggtgaccgtatcccatgcgaggaaatccggccagatgaccatcagctcacgctggctgaaattctggcggtaggctttcacctcggaaatggtcttacagccccatgcgctgatatatccgaaagcgcgcagcttctgacagacggatgccagtgcaacagccacctctttggtatccagtcccggcacaccgagaatacgcggtttaacaccggttaccgactccgccgccagcagggcttttagtccggtgtactgaccgttttcgtcggtggtgccgatgatattggaaacggtctgcgcgagtttcgtttcctcgtcatcaccggtgccgtcttccacgcgcacgacaacggtgaccggttttgactggtcagcgatggcctgcaacgatgccgccagcgtgccttttttaccggcctttgcaattgcgctttgcacattggtaatcagcaccggtttattgagggggaaggtttccgcatccgcatcgctggccgtgcagaccatgccgacaatggcagtggatacggtggaaatgacgcgggtgccgtcgttaatctccagcacctgcacgccatgatgatagtcactcatccgtttaactccgtggttaatgggtgcaactattttctgttgggcagtgcatgagacgctatttgacctgactggtcagtggatgaaacaacagataaagaaaaggcgggcaattcgcccgcctgtcctgatttgtactcactcattttccgcctgacaatttacatagcccaaatgctatcaaatctgacagtctgctttgagcgaaaagtggacattagagttacaaaagcaagtttaaatcatccaaaatattacaatgtccttatctatctgatatcgttataataaaaagctcctgaatataatcgatagtaggtggttatttccatgaaatcaattttagaggtttttactcaaggaaatactaaagaaaaactggctgttatcgccgatctcacaaccattgcgggaatatcgattgcaactattattgctggtttgttaaccctagttgcaaaaacagataaactagatgttggaaatctgtttggagttgtcataatatctctgctcggattggctggtgtttgctgttttgtggccttatttatttgggttataacccaaatgtctaaaccatggggaacacctcggggggttcagcccttagttaagtgtgctatttcccttatctttatctgtatgtttttgctggctgtctttacattttatgagtttatttcttcgatgagcatacgctattgaatataaaatcagcccccataacttaaaagagaccttctatatcgacttcaatgcccaaataacggactgtgctttccagtttcttatggcccaacagaagttggatcacccggagactcttggttttcttgtagattaagtaaggttttgttcttctcatggaatgtgtgctgtacagcgaatcttcgagaccaagcttttctacccacccatgaaaaattcggttgtattgccgggttgatatatggtggttagttccgacccgagagcggaacaggaagcctttactatgccagttgccgagctttatcaatgcagtaaccgcttcccttgtccctttggttatctcaaattggacagggctgccggttttctgttgcaacaccgttgctctgcttgagacagaactgccatatgcagcatctgatactttgagtttgaccaaatcacagccccgtagcttagtgtccaaagccatgttgaacagagctagatcgcgtgttttaccttccaactcaagtctaatccggatcccccagatatgagatatctgaagtggccttttttgaccgatggtacggtctttattccacggtgacgttttcatattcaaatctcctgcaatgtgggagatttgagtatggttgtctctcaagagcgaaaataagtcaactatcactagttgttgcgcatgtacgtattctgtcaattaattattgacaatcatcaattctggaatgatcaaaatcatcatatcgaattatagtctggttgactgtatctattgttggtgtcatttctgttataatatcctgataacctaaagagttaaatacatttactaaggcctcacaccgaagggccgtagcaattacaaaattataaattgccagccgtttattttcttgtttaactgcaagaatgaattcgatagcagtattttcatcactttggattgcattatatagagatactatatttaccatatcatcagagaatgtatgtattgaatcacaaaggggaacgtaatgggcatgatagtgtgtttcccagccaattaattcaaaaagttttctggttcctggatattcaggtgtatttggccacaatctattaaatagatcagttagttcttttcccatgcgaatcctttcatttgctgctggattagtcattcctttggattttaaacactccagccaccgttttccattactatgaactaatttcttactagccttgagtaatgcttgtgcattttcgccatcatctattgctatataaaattgattggcagcctgttctattataaccctagctaatacttccgatgctgaaaaggctcctatattcaaagaagagatagcctgattactaagttcattcagtacattaaagtactgtaagaccatcaatttttgttccacaccctttaggttgtctattttatttttatgctcctcaaattttgcatggatatatttatttatcgcggctattttttttacatcttcgtcaagatcaaacgggcaacgtccaaacaattcttttttcatatatttctcctgttgtacaagcttccataagttggcagattatacactgaagattacctataaatagctgtgcgggatagcagatcagtgcaagaagtacaaccaagtgaatgtgcgtattcagatacctggcctaacgttcgcgatagccgtcccctgcacgaagccatatattagatgtattagctcagaccttatctgacaggttgagtaggtagaatctaatcaaagctgacagtctggtttggactgtgagttcaaccgatggatgcaacacacagcgatctacggacattactagcatagctgtgtattaatcatcgggaagcaggtcagtccgctcctagcacagagcagactgtcagattaggctttactctgtgctatagatacgttagctcactccagagatcatacaacttattgcggcatttccggccattcaggatttgcaggatccacacggctgaccagaacactgtagcgttcccatgcttccagtcggctacgctcctcatctgttgccatattcagtctgacagagcgttccagtggctgaatgatagtttcagcttcggaaagcaaagctgacttctgtaattccgccagttgcagctgttcgtctgccgtataaatccgcttaatcacggcaccatccttaaacatccatttacctgagtcatcagcacgtcggttggcggtaatatcaggaacctcgacaacgctaaaaccttcagggttgagcgttgaagcatctctggtgatgccgacaattatattattctcatcgtaaacaatctttatcgtgtcttcctgaaaattacttacttcctcataccagttttttccctcttcggaccataaccagataacatcaaaattttttgtcagttgatattgggcaacagtttttggattacccgcagtaatattttttaaatgctgcataaattacacctgtgcgacgttataccatgtgccattgatgtatttttgtattggtctgaatactgcggggtcatcaccatcgacttcaccgacaataccaagcccggtaattacgtgccctgctttctcatacatcacccctttctgcatggtctggacaacacgtgtgccaagtctgacatctctcacatagcgggaatcaaagttaccgtaatccgagggattaacacgccccgtaatatttatggttttattactttgaacgcttccggagacaaagcgcataacatggacgctattagcataaacatccagattaccatcaccattttgtttaaagcccgtgtcattatcacccaaaacaatcgaattaccgccaagagcactggatgttcctatacccagagcaccattcaattgaccaccagataatgataacgccccaacatcagcagcagtcggtttaatgtacgaactgtaaattacatatacagttccatctgtcaggcctgttggtttattcgctgtataagttggtgatgtatgaatcgttacgctggcgttactggtataatcccactgaatattaacacctgtggcgtaattacctatttcaacataaacatcataggtatcaccggatgtattcacccatgcaaaattagtaaatccaaccgatgtccgtcgccataacgcaccagtaagaccttttggatttccatttcccgcacgaagaacaagttcagatataccagcctgcataggggagttaacattatatccggcaccaccaatcaggcttatgtaaaccacggaactggcctggggcatggttacagttgccagcctgaaccatcctgtaccaccactaaaagacatggttgttgaatttgttgctccaatattgcgcaggaataatcttttatcaggaatatccgcaccgttctgatctttctgaagacgtttttcagcattgtcataggcagacttcaccgcttttggtgttgcggccagtgtttcagaatcactgttggtggcgctactgagctgaacaagcccttttcgcgctgtggtggcatcctgtgcagtgtatttcccgttagcaaggtcatacgcgacctttaccgcctttggcgttgccgcaagcgtttcagaatcactgttggtggcgctactgagctggacaaggccttttctcgctgtggtggcgtcctgtgcagtgtatttcccgttagcaaggtcatacgcgacctttaccgcctttggcgttgcggccagcgtttcagaatcgctgttggtggcgctactgagctgaacaagaccttttcgcgctgtggtggcgtcctgtgcagtgtatttcccgttagcaaggtcatacgcggcctttaccgcttttggtgttgcggcgagcgtttcagacgtgctgttggtggcactactgagttggacaagaccttttcgcgctgtggtggcatcctgcgcagtatatttcccgttagcaaggtcatacgcggcctttaccgctttcggcgttgcagccagtgtttcagacgcgctgttggttgcactgcttaactgagtaaaaccttttgcggtcagcgaggcgtccgggtgacgtcgtgactgttcatgctctgcaattttgtcatcaacgtaatcctgcgttgccatcaccgttgtggtgtcaatggtcagctccactgaggccacactgctgacgatgatgaccatgcggcaggtctgcgaacgccctgagccttcggcaagagcgggtttataactttcagccatgttcgccacggcaattagcgttcccgcatcatcgtacaggccaagctcacgcatccagaaaccgcccacctccggcggaataaccagctctgcgataatataattactgtttcgtttgtccagggtgattttgttcagcgcatgtcgccagacttcatggataagcccggtctgtccggcatccgggacaggcaatttaccaccgccatccccgacggccatcgtggtaatgttgaccttccgccctcccggtgcggttgccgctgccagctttgctgcaccggcagtggtgataacggttttgaattttgtgctcattattcctcacttatccggggtaaaccgtaattacatcgccgtcgtaagccacaccaccggcgaacaggtagccgggaatgtcccgggtaatgttcaggccaataaggtgacggcttgcaggtttggcatcagcaatcagccgttccatttcctgatacattgcctctgtgataccgctttccagtacaccaatatcaagccggaaggtgccgggcgggtcactgttttcccaccactccgtcacgttgatgagatagccgagcggctccaccacacgccggattgcacctatcgtgcccttatgacagtggatgaaataggcatcgcggataacggcgcgttttgtcgcttccggccacttttcatcccatctgtcgaccgaaaacgcccacgccagccacggcagcagatttgccggacaggtattcgggttccacagatcacgaatactgaccggcgttttttcaatttccgcacaggcttttgcggcggcaacttcaagcggtgatgagccggtcggcagcagtcgcgaatcactcatccgagcctccggtcacgacgtggtattcggtacagaaagacgcctgcgtactgttgagcacgatatcgaccagtggtgcagccagttcgacacgctgcacgccttccacatgcaaagcggcataaatggcagacagacggatgtcgcgccccagccggtgctgtgccgtgatgtacgcttccagttttttcacggcagcagcgcggatgggttcgctttcgggaccagggtaaaggtaaagcgtggcgtttatctggtattcaacgatggcggcagactgcacggtcacgcggtcggccaccggcctgacgtcctcgccattaagggcgttacgcaccaccgccagcaggtcttcggatgcgacaccgttattttcacgtgacagcacagagatggtgacgcaggccggagacggactggtgacagagatatccgcgacacgcccgtcggcactgcgaccatgatactgataagcccccaccgacccggcgacgcttaaaccttcaaacgcctgctgaatacgcagacgataatccgtgtcagattccatcacggccggtgtcggcgggagggtcgaatcatctgccggggtgatagtcagacgcgtggtgttgtaattggcaccaatcacatcaaggtcattaccggcggcacaggccagcattaccgcccgtgcggcctcattcacacgctgacgccagataagctcacgataagcattttcctccagcagtttgacgagaggctcggattccagcatcagggcacgggcgaccgcctcctgctggtcttccgggtaaagggaaatcagtgtcgccttgcgttcagcaagaatggtttcaaagtccagctcctcgaccacatccggtgcgggtagctggttcaggtcgataatcggcatggtttcaactcacagggatggttaacgaaagtggctggccggtgtcgttgtgctggccggttaacgtgaccgtcattcgcccgtcaaaactgcgcgccgtggtgacggatgacagggtgacgcggggttcccatttcagcactgccatgtaacaggcgactttaatctgcaactcaagcgccggggtctgcggctggtcaatcattgacgccagcaacgagccgtaatcacgacgcatcacccgtgagccgaccggtgtgcgcaggatatcgccgatactctggctgatatgctcaaggtcagtgacagtcaggccatcactgcgattcattccgagataacgcgctgtcatagaggtccccctgttgtgccgccactgtcgccggggtgtttatgggtatgcagtaccttaccgtttgatgagagttcaccgccggtgtgttcaatgttgccgcgcatcgtcccgcccttctgcacttccagcgtgccggtaatcagcctgttggtgcagaccacctccggtgtgtccagggtgacgcgggttgatgctttcaccatgaccaccggcaccgtggcagtaacagaatcagaagccgtcacgctggccgttttaattccgcttaccgtaagtgcactggtttcgggttcatactcaatcaccaccccgtcagggaaacggatatgcagggcatccgccgacgcagacggcgcggggttatcgccggaataaattcccggcagaacgaatgccgtgtcgagttcaccgcccacggacagaatcagcacctgttcccccacggaaggtgcccaccatgtgcgcgaacgaccggcgcgatgggtcagccactgaagccagtcggtgcacatgccgccggtctgcacgcggcagcgaccggcgttaaggtcggtttcgacgataatgccggtgcgaatcatgttgcgcagtgcgcgcgcgagttcctgaatatttgcgagagtgttcatgcatgtgagattgcacaatatataaaagttatgctatctggattcatttgtagaactaccagacaacattcaaggagagcgtaatggtcagctataatgtgactaatgtgtgggggctaatcgtttttttcctttgtagctttgcagtattagcattttttagctttggtaaaagtaaccttatgaggcttattgcacattatttcaattttggatattcagacaaaaaattaaaaagacttgaccgcgagtggcgcgacattcaactatttaaaataattaatggaatcaatgtatcaggcattgaaaatgtgagaatgatacagcagggactgattgatggaaaactaaaaacatcgtatttttcccttactcgcatctggggtgacataacaaaaccaccacacataattaaaacaataattgtaattctggccagtattttttacattctcctcgcatgttacatacacaacgaacaatccgttatagtaagggatgccataggcataccatataaaaacatgatgtactatgtttatagtgacaaagttcttttatccttcaaaaataaagcagttgaatttaataaaacttatagccttgccgattgcaagagactgcaaaacgtatttataaaagacacacttcctgagatcgcctgcaataagctcttacagctaaacgaggaggactccgaatggttaagccaggagattaaagataataacagtcacaaaaaagcattattaatactatccctgaagccgagagtgtccacacagtgtccacagtagagtaacgtttaagggctttcagtggtaatttatgccgctcaaacccgcattgtaccgttgaaagcccctactggtgacaccctaaatctcccttacacgggcttattttttatgcataagccctatccctggtcaccgtcttccattgaccacatcgatagaatactccttcatagcacgatgcctttcacttatcgacatcgtgctcccacaggttccggctacgcacagccagaacgcgcatgtttgacgcttaccaaaaaatgaacctaaagcattggaatatttttgacatcattttctgatggctgcataaaataaaaattctgctttagtttcatctatctgtttgtcattattactcacattcaataatggtgttgaagaatatcccatcacagataaaataaatatgtgcatggtagtcttgaatctattctcactctccacatttgaatgtcagacgagcgacgccatgtaatcctgcaccttctgtcttcaggtcaactatctgcatttttttgccctgagtaacacagaaatgagttgcatcattttttactatattttctgcaccagatattctacccctggctaaagaagcttcggcttcggtgtagtattggttatccagtttacgctgaatattacttttatatgcaaggccaaatttaccgatacttgtctcatcattatgcacagcacaaccagacataagaaaaacactaattaatgatatagcagctatctttttcaccttaccttcccccattaattaccaacgacattctctagtgtttaaatataataatggcatgattattataatagaataggattataataaatgttctgtacaacatttcctacataagtaggaattacagacatggaggcccttccgggcaaccccatgggggactttaatatattttgaatagtatattgaagatgccactgtttagttgaatattaggtatattctcttttttaaaaatttatcagtggctaccgttaatattcgctgtccccattgtaagctcctggtggtaagcactgaatccccatacctgaactgactttttatcctccgactttcatcctgttctgactccaccttttcttttctgctctacactatctacagaccaatcataaaggcacatacgatcatggcagaatttcccgccagcttactgattcttaatggcaaaagtactgacaatctacccttgcgcgaagcaattatgctgttgcgtgaggaaggaatgacgatccatgtgcggatcacctgggagaaaggcgatgctgcacgatttgtagaggaggcccggaagttaggtgtcgcaacagtgattgccggtggtggcgatggcaccattaatgaagtttctacggcattgattcaatgtgagggggatgacatacccgcgctgggaattttaccattaggaactgccaatgattttgccaccagtgtagggattcctgaggcactggataaggcgctgaaactggcaattgccggtaacgccattgcgatagatatggcgcaggtcaacaaacaaacctgttttattaatatggcgacaggcgggtttgggacgcgtattaccacagaaacgccggaaaaattaaaagccgcgctgggtggcgtctcttacatcattcatggcttaatgcgcatggacactctgcaaccggaccgttgtgaaatccgcggtgaaaactttcactggcaaggtgacgccctggtcattggtattggtaacggtcgtcaggccggtggcggtcaacaattgtgcccgaacgcattaattaacgatggcttgctgcaactgcgcatttttaccggcgatgaaattattccgactctcgggtaatgactccaacttattgatagtgttttatattcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagcctgtcatacgcgtaaaacagccagcgctggcgcgatttagccccgacatagccccactgttcgtccatttccgcgcagacgatgacgtcactgcccggctgtatgcgcgaggttaccgactgcggcctgagttttttaagtgacgtaaaatcgtgttgaggccaacgcccataatgcgggcagttgcccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggaccgctgatagaaacagaagccactggagcacctcaaaaacaccatcatacactaaatcagtaagttggcagcatcacctgcgttgacacaaggggaagttaaatgaaaacagaacgtattctcggtgctctttatgggcaggcgttaggggatgcgatggggatgccctccgagctttggccgcgcagtcgcgtcaaagcacactttggctggattgaccgttttctgcctgggccaaaggagaataacgcagcctgttattttaaccgcgccgaattcaccgacgatacctcgatggcgctgtgtctggcggatgcgttactggaacgtgaaggcaagatcgatccggatctgattgggcgtaatattctcgactgggcgctgcgtttcgacgcctttaacaaaaacgtactaggcccgacctcgaagattgcgcttaacgccattcgcgacggtaaacccgttgctgaactggaaaataacggcgtgaccaacggcgcagcgatgcgcatctcgccattaggttgtttgcttccggcgcgtgatgttgattcctttattgatgatgtggcgctggcctccagcccgacacataaatccgatctggcggttgcgggggcggtagtcatcgcatgggcgatttctcgtgccattgacggagaaagctggtcagcaattgttaattcactgccttcaattgcgcgacatgctcaacaaaaacgcatcactaccttcagcgcctcactggctgcacgtctggagattgcgctgaaaattgtgcgcaatgctgacggcaccgaatccgccagcgaacagctttaccaggtcgttggcgcaggtaccagcactattgagtccgttccgtgcgccattgcgctggttgaactggcacaaaccgacccgaaccgttgcgccgtcctgtgcgctaaccttggcggcgacacagacaccatcggtgctatggcgacggcaatttgcggcgcgttgcatggcgttaatactatcgatcctgcgttaaaggcggaactggatacagtaaatcagcttgatttcaaccgctatgccacggcgctggcgaagtatcgccaacaacgggaggcgatatgagcggcgctcgattacacacgctgctgcctgaattaacctcgcgtcagccagttatggtgattggcgcggcggtcattgatgtgatcgccgacgcttatgccctcccctggcgtgggtgcgatatcgaactgaaacagcagagcgttaacgttggcggctgtgcactgaatattgccgtggcattaaagcgcctcggcatcgaagcgggtaatgccttgccgctcggtcagggggtgtgggcggagattattcgcaaccggatggcaaaagaggacttaatcagcctgatcgataacgccgaaggtgataacggctggtgtctggcgctggttgagcctgatggcgaacgcacttttatgtcattcagcggtgtggaaaatcagtggaatcgccagtggctggcgcgattaaccgttgcgcctggcagcctgctctatttttccggttatcaactggcctcgccctgcggcgaattgttagtggaatggctggaaaagctgcaagacgtgacgccgtttatcgattttggcccacgtattggcgatatcccggatgcattactggcgcggatcatggcctgtcgacctttagtgtcactcaatcgtcaagaggctgagattgccgccgaacgttttgctttatccgcagagataacaacacttggcaagcaatggcaggagaaatttgccgcgccgttgatcgttcgcctcgataaagaaggcgcatggtatttcagcaacgacgcttctggctgcattccggcatttccaacgcaagttgtagacaccattggggcgggcgacagtcatgccggtggcgtacttgccgggctggcctctggtctgccactggcggatgccgtattactgggcaatgcagtggcgtcgtgggttgtcgggcatcggggcggtgattgtgcgccaacgcgcgaggaactactcctcgcacacaaaaacgtatagatcgctgcgacagtggctgatgctgtactcaataggccgttgctgttggtcaagcgccacttgcttgatcaccagcaccggtattttgctatctaactgaatatgtgactgaaactcggcatccggcatccgggcgctaacgcgggaacgcgtacgttgtgggtaaatgtgctggctgcggaagtagtcataaagagaaatcccgatggcatcaacatcatgaattaaatgtgccggaacccacgattcctcaatcgataccgcctcttcatcgacatagcgaatacgcttaagcaaaaagacatcacttcccgcttcgaccgccagctgctgcgcgacttcttcgggacatttcacgacacgcttgttaacccatagcgtatcgggctttttcccgcgcaataccacctgctgagaaaacccccgcgcttctttcagcgagtattcgaagatgttgttgatctgcgtgccgtaaccacgcgaacgcgtcaccacgccctcttcttccagcgcctgcatcgccttgcgcaccgtaatgcgcgaaacgccggttaactgacttaaattacgctcaccgggcaaaatattgccatgctccagcaccccgttgcgcacggcattttttaccgtttcggcaaacttaatataaagcggcgtgttatccgccgctaaaatacgctcgttcagttgggcaatcagctgggtatgcgcttgttccatttgtctttttcctgccggggagtctggtaggagtatatcactgcttcatatttaaggcgtttctttaatcccatcaacgaatgtctgcaactcctccaccgtgccattaaacacattaaaatccaccgaaccattaatgccatcgacctgtccacggtcggaatgctgccagaagcgccaggccatgccgtcattgtccggacgacgttgatagtagtgagccacccaccacggatattcattgaaatagcccgccagattggtgtgataaaaaacggctcctgagtaaataattggcttttttcccgtacgtttttcgaccatttttagccactgacttacccgcttgcgtaattcttttgccgataattttccccgttcttctacgtccagtaccgcagggaaatcgccttgtgagaaatccaccgtttgcagaaataatcgcgcctgaactgaagcggataccgacggggaaaaataatgatacgccccgcgcagcaggccattttcgcggcttagttgccagttacgcaaaaaataggggtccaccagcttttcgccttccgtcgccttaataaaggcaaattgtaagcgaataccgttatcgcgcatttttgccacccgctgccagtcgatccgctcctgccagcgcgaaacatctattccgtgaatggtgtaactggcaggaatgcgaatagcgaaagatttaaccgggcgataaccgtagaagtgaatgtagtctttaatctgaattgctgtcgaatagaaaaaattcaccgtctgacgcggataaattgcaacgatggaaattagcccaagagcgcataataaaacggtgaatttttttcgactggtgattctcaactgcattggtttcatccctgaatgtcagcaccaaaggctgacaataaccaaagcagctatagtacggtgctcaccaccaggcgtggaagtggtgaaccggaccaataccgtgaccaacttccagcgtgtcggcctgggctaatgccgatgaaagccagctttttgcctcctgtacggtgtcagcccagtttgtatggcgcgggcgcagtgcagccaacgccgcagagagcgtacaaccagtgccgtgagtgtttttggtcataatgcgctgtgcggtaaaccgttgttcaccctcgcgggtaaacagccagtccgggctttgctcatcatccagatgaccacctttcattagcactgcgccacagcccatcgccaacagcgatcgcccttgttccagcatttcctgttcggtacgcgcgtgtggcgcgtcgagcaaggcggctgcttcgggcaagtttggtgttattaatgaaacctgtggcaataatcgactgcgtagcgtggcaactgccgaaggtgaaagcagcgggtcgccgctttttgccagcataacggtgtcgagtaccacgttttggatctgataacgttgcaaccgttctgccaccgcttcaacaatatcggtttccgccaacataccgattttagtggtgtcgattcgcacatcgctgaacaccgaatcgagctgggcggcgacaaaatcaggctcaatgcgatacaccgactgtacgccacgggtattttgcgccactagtgcagtaataactgagcaaccataagcgccaagtgccgagaaggttttaagatcggcctgaatccccgcaccaccactcggatcagtaccggcaatcgtcagagcgttaattcgtttcatgcctgcacctcctgcgccaattgccagagcgcatcaaggaaatgtggaacaaaactacctggcccctcgcttctggcgactgcgcgttctccggcttgtttcatccagtgacaggcagatgcgatattttccagcgtatcgcctggtagcgcacaacaggcagcgacaaccgccgatagtgcacagccagttcctaccactttggtcattaatggattgccaccgtgaataccaacaatgcgatgtccatcggtaacataatccacctcgccagtgaccacaacgattgcgccagtttcccgtgccagtgtttgtgcagcaggtatcgcgttagctgcggcatcagtggtatccactccccgtccaccattagcaacgccagctaatgccatgatttccgaagcattaccacgtatggcggttggcttatgggacagaagttccacacaaaaacggcggcgataatcgagcgcaccaaccgcaaccggatcaagcgtccagggcgtttgtgatcgtgttgcttgctcaacggcagcactcatcgcttgcactcgtggctgcgtcagcgtgccaacgttaatcaacaaggcactggcgatagccgcaaactgactggcctcttcggtttcgataaccatcgctggcgatgcgccgagcgccagcaaggtattggcagtaaaagtttgcaccacatcgttggtcatgcagtgcacaagaggggaatgttggtgaaaaaggtgtaacgcgtgcgcagattgcgctgaactcagcaggtcgacttgcatagtttgctcctgccataacgtgaagaagcaatgacctggtggtccgtgacttccctacgctggcattatccagatcaggtgatacgggtatttctcagccttcacaaagaagggcaccccgagtcgtttggttgcgataataaatcgcagaggaggatggtaatgtccagcgcacgcgttgtaaacggggaaaaacggcggtattacaataacgttgtgaaattatttgatataagaatccagcaccttcagaacgacatccagatcttcttcacgttttagctcatccccctggtgaacgatgtgttccgtcagatggcctttaatcacttcccgcatcagaccgtttaccgcgccacggatagcagcaatctgttgtaaaactgcagcgcattcatgcggttcgtcgagcattttcttgagcgccacgacctggccctgaatcttactggcacgcgctttcagtttctgtttatcacggattgtatgagacatggcaacacctggttaacaagaatatgaaaaatcatagcactattaatctactggggggtagtatcaggtactgggggggagtagaatcagattgccgaattaatactaagaattattatcatgaccgaatttacaacacttcttcagcaaggaaacgcctggttcttcatccccagcgccatcttacttggtgcgcttcatggcctggaaccggggcactcaaaaacgatgatggcggcgtttatcatcgccatcaaaggcaccattaaacaggcggtgatgcttggactggcagcaactatttcgcataccgcagtggtctggttaattgcctttggcgggatggtgatcagcaaacgctttactgctcaatcagcagaaccgtggctccagttgatttccgcagtgatcattattagcaccgcgttctggatgttctggcgtacctggcgcggcgaacgcaactggctggagaatatgcacgagcatgatcatgagcatcatcaccacgatcacgaagatcaccacgaccatggacatcatcaccatcacgaacatggcgagtatcaggatgcccatgcacgagcccatgccaatgacattaaacgacgctttgatggtagagaggtcaccaactggcaaattttgctatttggcttaaccggtggccttatcccctgcccggcagcaattaccgtgctgttgatttgcattcagttgaaagccctgacactgggcgcaacactggtcgtcagtttcagcctcggcctggcgttaacgcttgtcaccgtaggcgttggcgcagcaatcagcgttcagcaggtcgcaaaacgctggagcggatttaacactctcgctaaacgcgctccctatttttccagtctgttgattggcttagttggtgtgtatatgggcgtacatggcttcatgggcataatgcgataactcaatcctttaggctcgcatgttatcttcagccctggatgattcttaaatcagctatttccgctgactctctgcacgctaaggatgcttttagggcatcctttcatttacactttttacgaaatcatgggatcactaacaaaatatcgcttgtcagttatattgtatggcaggaaagatatgcgactgatattacagatccccaaagtggagagtttatgaccattaaaaataagatgttgctgggtgcgcttttgctggttaccagtgccgcctgggccgcaccagccaccgcgggttcgaccaatacctcgggaatttctaagtatgagttaagcagtttcattgctgactttaagcatttcaaaccaggtgacaccgtcccagagatgtaccgcaccgatgagtacaacattaagcagtggcagttacgtaacctgcccgcgcctgatgccgggacgcactggacctatatgggtggcgcgtacgtgttgatcagcgacaccgacggtaaaatcattaaagcctacgacggtgagattttttatcatcgctaaaaaaaagccccctcggagagaggggggaatgcagacaccttaatatttttattattagccacttgctcgtcttgcttgttattagtcgtatttcacgttgattaatgcggttgcctccagtgcgccagatttaactttgtttgtatcgtagacgtagtaactggccgttatcggaattgaaaccgttgtatctgtaagttttgactttgccgcaatttcttttaaattcgtatatcctttactgctgttagtgatatttaaaagtgtgactggcgtaccattactttcaagaataaatcctacgccattatcttccgcacctttcaggatcgtgttgctgttggttaacaagtcagaacttgataaatacacctgcattttccgtgatgtttgattttgttgacctaataaatttttacaacgcagaataatatccccttttttactatttattgttgttttgttacctgtggctggtaattgtgaaacgggaatactctctaacgtaattaataaatcgtccggtttgcaggttgtggttatcgggttgtatgacaatgtcagattaaaggaatagacacctgcattttgtgccaatgcatttctgtagctatttacacatgcatcccatgacttaccacctaataaacacagtagaaattgtactgcggcactcccgcgtgtcgatgatgaagcactggataatgtcgcaactccattaatcatcactgaaccaccgctccccgcagaaacattcacttttgcattactggccgcaggtgtcaccgttaccgaataaccactggtgaaactggtctgattatttgacaacgtaatgttgtttttatttgtccattcaaaatgtaaatttaatttaatggtatcgttataaagtccaacaataatatccgacgggctcataggggtgatagtatttgtactcacgcatgacgaatcattaaaattatgctcatatgtcgccatttgtgtttgagtaagtgcaaaatccccctgaacaaccaaattgtgctgaacagataactcactataacatgccgcatagctcacaggcataaccatcatcattactataaatagcattatgcgaatttccatagaaccacctgactattactggcaaatataatttttactttcatcaatctctttaccgaaggtgattgtgcatgaaagcccttgttgcttatcaattgccacattaaccgatggcggtacttcattggtgcgaataaataactgacttccctggccgacaacaccaatattatgaccatggatatcattgacttcataaccaaacgttaatggttgcccatccgctcttaatgcttttataaaccatggcttgcgctgatcggtatcaaaattaaccagtacaaccgcgccgcgataaggggcggcaattttccggttgccacgtaattctgcttcgctatcgctttgtgacacatccaacatcaggtaattttcccgataaggtgtcattccgtcgtataccaccactccattacggtttgttgtgcgatatttttgcccattgacataagcatctttaattcctggcgcattcatcacagcaaacgtttcagaaagacggtttgccagattaacgccacccgaccaggcgacaatgccccctgaaacactggctccagcctgtcgataagcactcgactgactataactgccattcactgtcgcaaccggcgcgttccaggttaaattcgccccagctgtcgtttcatttccctgatactgataactcaggttgaccccatagttaaactgatcccggcttccaacggttcctgataatcccgtattatttgaggcaaccccctgatcatcaaacgtcgttgagttagacatatatatttgccgacgaggcgtcgtaacgtcatcaccccaatcaaagggaatcgatataaaaatattaaaacgtttctcttcatgatgattctcgtcataagcatggcttgccgcgagggtatagcttatccttcgcaagttgttggaataactcaactgataatccttactgctgccgctacgcccccagtaatctcgccataacgtacttaaggacacagaaccccagccttctggcaatgactgactcatattggcagagaagctatttttacggccaaaatcgttctggtaataatcggcaatgtcatagatatcgttttcatcatggcgataattatctttattgtttgcccatacgtgatcattaaatgtccgataatcacgcgacgaataacgccaggccgccagaccaaaacgtgtcgacgtttggctcacaaatttgttgtaggcaatttgataactttgcccgtcaaacacatcgccgttgtcttgtttactatgcgacttcgtggcatcgacggaaatggcaccaatgcgtgtattccagccagtccccaaagtgaacgcgtaataattattcgcgaccatcgagccaccatacagcgttaataagttattaaaaccatactgatgacccgcctggacaaaatcactttgtttgctcgccccttcaatatggctacgacccgccgcaaaatcatatttcgacacgccgggttgcagcatatttggtaccgctgcataaggcaccagataggtggttaccgaaccgtccgcctctttcacgctgacatcaagatccgctccaccaccggccaactgcaaatctgtaatcgcaaacgggccaggaggaacctctttctgataaaccacaaaaccattctgttcaatagttaccagcgcgttactctgagcaatcccctgcacccgtggcgtaaaattttgtttcgagttaggcaacatctgcatatcacgaaacaaccgcacaccgctgaagcgaacagaatcaaaaatatcgcttgatgtgtacatatcacccacacgaagcgtgccgagaagttgggcaaatccacgttccagatacagggtattgcttttccacacccctggattgttatttgttttactgaaactggcatcagaatgcagttgccactcctgtaaatttaacccgctgttaaaacgtacatatgtactcttgctattaccggacgctttataatcgctgtaatactgactcacataataagaggtataaaacgcattaataccccgctcccagttttctggtggaacatagccactttccagctcttccacccaggcctgcgggacactgaaatcgagacgaaaaactccgatatcccaggtatagctcccgccctgaataagttgcttaaatgttaaacattgcttaccgctggcaaagttatcggtattaatgcctaaccgcttgatcatttcccttgataaacatgtttcttgcgggttgtctttaacaatgatctcatatttcccacgccattgcttattgacataaatatcgatgtcatactgccccggcaagggctgattatcttcaagacgaatatttacaacctgctggtctttcattccacctatcatgaaatgggtatcaaaggtttcttcagctgcataagcttcaatgccgatcaataacgctacgattgctgatgcaagtggggtcattctcaacataggcagctcctgcaattaaattttgtcactaatataattgccatggtcatcgataatggtcagatgccagttatttgcattattacttttgacattaacactctgactttctaagggggcaatcataatagtttcataattgactttgacattattagctttgacatccgaaatcgtcacccaattagctgaggcattttttatcaccaatccattgccactgcgatttaccagtaactttttaaaggtcgctttatttaccggagcaatacccgctggccggtaaaacaacttaattctgttttgcatcgcaaacttcagtgcattcttaccttcttgttctggactatttggtggaatatccagaacattcagataaaaaatactctctttattagtaggtagtttattcggcataattttaatttttacttgctgcccggaatttgcccctatttttgccactggtggcgttaacatgaaaggaacctgaattttttctggtggtaatgacgtatcgccatcatcaatccacgcctgcatcagcgaagaacggtttccctggttcatcaactgcaccatcacttctttgtgctctgccgggtaaataatacgcgtcccgtagataacaataccggcatgtgcaggaaggaccatagaagaaatgagtaaagctaataatcctttcatcttaatgcctcttaaattaaaaggccgccatggagatagcggccatgttaattacctgaagaatcttgcaattttatttattaatcctgcgccacacgcataatcagggaagataacacatcacctgaattcactgagttatctgtcagtttcaggtattttgctttaaacggaatggcatattgaccgtccgctgttttataactctcgatgttgaaaggtgcagaaacatccaggacatcgctgttatcacctaaatagagataataacccacggtatcgttgctactggctatcgccttatcgtttccggttattttatcgttggtaatcaacgagagttttacaccagcaacttctttcggacagctaatttttaacatgctgctggttacaccgactgcaccatcataggtcgagtatttagctttaccttcaaagaccgtagttggtacagttggcatattaatacttactgaatcgccacctgcttcgaatttacacggagattctgcaatattccctttaatggttaatgttccggtatcaacgtctgcggcaaataccccagcgctcataaaaaaagaagaaaaaacagcggcagcaataattgaacgtttcataatatgctccttaataaaatctatttttggttgttaagagtctgtatctcttggaaacaaatttctcacaccaaaaaagttgccgcaatgtaaacacattgttttattgatttaaagcaaattaactattgcaatataaacacaacaaatacttaagcacattaaatatttatcaaatctattaattaatgtggatttctataaatggtattattaatatcaataaaaaaagcttaaatcattcatgtaaatgatttaagctttctaaatccgattaaaaccagggtggcaaattaatcgtagcgatttaacacgattcgacgtttgctatcgctatctgcagcaatcacttccgtcgttacacctttaactggcgaagaaacctgatgacgggtatcaacattatacgttaactgaccacaatgctgttgaggttgaccattaaccatagccatactgcatgtcgggggactgatcctaccattaatcgttaatgtggcagtttctgaagagaacgcgggagaggccaatccataggcaagaaaaataattcctgacagccaatacttattcattgaacgttatccctgtagtaaaggttatgcctggatagaatgagtgcataacaaactatagctgtacatccactacacagccacgaaggatgataatgaagcattgcctgtacgatcaatcgactttgtagagtttcggacgaaggtccgcagaatattcgcagcattaaataagtgttcattaatgcggcaaaaacaaatacaccgcatcaatgtaacatctctgcggtgtatgaagaataaccagaatggttaatacgcgttagaccgcgcggaaggaaatctcgcctggaatgacttcaccctgccagtagagctgagctgcaacgcggtcagccagctggcggtagatagtggtaaattcgctctcaggacggctgataaccgttggcgtgcctttatcgagatcctcacgtaaggagatgtgtaacggcatctgccccagcagctgtgtgtggtatttctcggccagtttctctgcaccaccggtaccgaaaatcggttcatggtgaccacagttactgcaaatatgcacactcatgttctcgacaataccgagcaccggaacctcgactttctcgaacatcacaatgccttttttcgcatcgatcaacgcgatgtcctgcggggtggtgaccacgactgcaccggttactggaatgttttgtgccaatgtcaattgaatgtcaccggtacctggcggcatatcaagcaccagatagtcgagatccggccacaaggtttcctgcaacatttgcattaacgccttgctcgccattgggccacgccacaccatcgcattgtcgtctgtcaccagataaccaattgaattagttgccaggccatgagacataatcggtgccatatgggtaccgtccggcgaagttggacgctgattttctgcgcccagcatggtagggattgatgggccgtagatatcggcgtccagaatgccgactttcgccccttccgccgccagtgccaacgccaggtttaccgccgtggaggatttacccacgccacctttaccggaactgaccgcgataatgttcttcacgccgttaattcccggctgattcttcacgcgtttcagagtggctatgttatgcgacagtttccagtcgatagctttcgctccggtgatgcgcagcagttcggcgctacattgctcttttaactcttcgaacgcgctatgccagacgaatggcataaccagttccacatgcagcgtgtcgtccatccaggcgacatggtgcaacgctttcagcgttgtgaggttatgcttcagggttgggtgctgaaaattggccagtgtcccggcgaccattgcgcgcaaggcttctggtgatttggcctgggattgttcgttcatcccgactccttttttgtatagataaaccatcagttgatagtttacctgaagaatatagagaagtacttacttaacattttcccatttggtactatctaagcccttttcactattaagaagtaatgcctactatgactcaagtcgcgaagaaaattctggtgacgtgcgcactgccgtacgctaacggctcaatccacctcggccatatgctggagcacatccaggctgatgtctgggtccgttaccagcgaatgcgcggccacgaggtcaacttcatctgcgccgacgatgcccacggcacgccgatcatgcttaaagctcagcagcttggtatcactccggagcagatgattggcgaaatgagtcaggaacatcagactgatttcgcaggctttaacatcagctatgacaactatcactcgacgcacagcgaagagaatcgccagttgtcagaacttatctactctcgtctgaaagaaaacggttttattaaaaaccgcaccatctctcagctgtacgatccggaaaaaggcatgttcctgccggaccgttttgtaaaaggcacctgcccgaaatgtaaatccccggatcaatacggcgataactgcgaagtctgcggcgcgacctacagcccgactgaactgatcgagccgaaatcggtggtttctggtgctaccccggtaatgcgtgattctgaacacttcttctttgatctgccctctttcagcgaaatgctgcaggcatggacccgcagcggtgcgttgcaggagcaggtggcaaataaaatgcaggagtggtttgaatctggcctgcaacagtgggatatctcccgcgacgccccttatttcggttttgaaattccgaacgcgccgggcaaatatttctatgtctggctggacgcaccgattggctatatgggctctttcaagaatctgtgtgacaagcgcggcgacagcgtaagcttcgatgaatactggaagaaagattccactgccgagctgtatcacttcatcggtaaagatatcgtttacttccacagcctgttctggcctgccatgctggaaggcagcaacttccgcaagccgaccaacctgtttgttcacggctatgtgacggtgaacggcgcgaaaatgtccaagtctcgcggcacctttattaaagccagcacctggctgaatcattttgacgccgacagcctgcgctactactacaccgccaaactgtcttcgcgcattgatgatatcgatctcaacctggaagatttcgttcagcgcgtgaatgccgatatcgtgaacaaagtggttaacctggcgtcccgtaacgctggctttatcaataagcgttttgacggtgtgctggcaagcgagctggctgacccgcagttgtacaaaaccttcactgatgccgctgaagtgattggtgaagcgtgggaaagccgcgaatttggtaaagctatccgtgaaatcatggcgctggctgacctggctaaccgctatgtcgatgaacaggctccgtgggtggtggcgaagcaggaaggtcgcgatgccgatctgcaggcgatttgctcaatgggcatcaacctgttccgcgtgctgatgacttacctgaaaccggtactgccgaaactgaccgagcgcgcagaagcattcctcaatacagaactgacctgggatggtatccagcaaccgctgttgggccataaagtgaatccattcaaggcgctgtataaccgcatcgatatgaaacaggttgaagcactggtggaagcatccaaagaggaagtaaaagccgctgccgcgccagtaactggcccactggcagatgatccgattcaggaaaccatcacctttgacgactttgctaaagttgacctgcgcgtggcgctgattgaaaacgcagagtttgttgaaggttctgacaaactgctgcgcctgacgctggatctcggcggtgaaaaacgcaatgtcttctccggcattcgttctgcttacccggatccgcaagcactaattggtcgtcacaccattatggtggctaacctggcaccacgtaaaatgcgcttcggtatctccgaaggcatggtaatggctgctggtcctggtgggaaagatatcttcctgctaagcccggatgccggtgctaaaccgggtcatcaggtgaaataatcccccttcaaggcgctgcatcgacagcgccttttctttataaattcctaaagttgttctcttgcgattttgtctctctctaacccgcataaatactggtagcatctgcattcaactggataaaattacagggatgcagaatgagacactttatctatcaggacgaaaaatcacataaattctgggcggtggagcagcaaggcaacgagttacatatcagttggggcaaagtcggcactaacgggcaaaaccaggtaaaaagctttgctgatgctgcggcggcggaaaaagcggaactgaagctgattgcggagaaggtgaagaagggatatgtggagcaagcgaaggataattctttgcaaccttcccaaacggtaacggactctctcaaggtagcggacttatccaccattattcaggaacaaccctctttcgtagcagaaacccgtgcggctgacaaaaatacagatgctgttttaccatggctggcgaaagatattgctgtcgtttttccgcccgaagttgtacacaccacgttaagtcatcgccgctttcccggagctcctgttcagcaagcagacaaattgccccaattacgtcgcttagcctgtagtgtatcgcaacgggataataaaacagccacatttgacttcagcgcctgttctttagaatggcaaaacaccgtcgcacaggcgatcagtcagatcgacggcctgaaaacaacacagctaccatcacccgtaatggctgtactcacggcacttgaaatgaaatgcacaagatataaagagcgtgaggatgttatggatcagattattcaggaaggcggtctggaatatgctactgatgtaataatacatcttcaacaaatatctattgaatgggattatgtcaacaataatattgttttcctgtcgtctggcatttcacctgattacttgcagcaatattccagctttgaattacgcctacgtaaacatttatcactggcggaagagtctctctggcaaaaatgtgcacaaaaacttattgccgcaattccacatattccagaatggcggcaaccattaattgctttgttattacccgaaaaaccagaaattgcacatgaaatttcccagcgtctactggggcaaaagaaattaccctcgcttgagtggctaaaaatagtggcgactgatgagcacattcttgcctcattagaaaaatatcacgagccatatgccatttttgatgattactattgtggtgcgatatggtcagccaccgtattacaggagcaaggtgttacagccctgccccgatttgctccctatgccgcaagtgactactgcgccgatgtgttgcgtcatatcaatcatccgttcgcattaacactgcttatacgtgtagccgggcatactaaacgctgtcacgatcgaatgacgaaagcctgcgctgcgttcccacacgcagcactggcagcactggcggaacttctagtgcaaaaagaagagaatagttggcgcattatgctaatgacgatgcttatctcgcatccgacactagcagaacaggtcattccctggctttcgacacccgcagttgcagtgctgaaatcatgtcagcaacaactgacacagccctcaaaccatgccagcgccgatctactgccggccatagtagtctccccaccatggctttcgaaaaagaaaaaatcgccgattccggtgctggatttagcaccgctcaacctcgaatccatatgcacaataaccgacacagaagctaaagagtttcaaactcattgggactgggaaccgcataagccaagtgaaggtgctaaaaatttcctttactcgctggggtatcgccgctgggattttgacacatataaatatatcggcgcttctgactcggcaattggcgcatgggaacgtgaggacttcgctacactcatccaaatgtttaaagcccaccatgcaccgtatcagggggagtggcatctcaactcacttccctttttacctatgcaaaaagcgattaagctatgggaatttctcagcaaagagccgcataccgcgataaaaccagtcatgctttatttgcgactggcaggtatgagtggttttctacactcgttttcacgctaccctcaagaatgttttgcggttgctaattattttgccgcaacggaactggctcctgccgtcgcccgcgccttcaacaaactcaaaacattacgacaagacgccagtagctggctgctgaaatacccggaacacgccattaccggcctgctgcctgcagcgctcggcaaagccagtgaagcacaggacaacgcccgtgctgccttgcgtatgcttaccgaaaacggtcatcagccattgctgcaagaaatcgcccggcgttataaccagccggaagtaaccgatgcggtgaacgctctacttgcgctcgatcccttagataatcacccgacaaaaatccccactcttccgaccttttatcagccatcgctctggacgcgcccgttattaaaagcaaacgcccaatcactgcctgatagcgcactcctccacctcggtgaaatgctccgcttccctcaggaagaggcactgtatccgggattattgcaggtgaaagatgcctgtaccaccgactcactggctgaatttgcctgggatctgtttaccgcctggcagaccgctggcgcgccgtcgaaagagagttgggcgttcactgcgttaggcgttctcggtaacgatgacaccgcccgcaaactgacgcctttgattcgcgcctggcctggtgaatcccagcataaacgcgccaccgtcgggttggatattctcgctgctatcggtagtgatatcgccctgatgcagcttaacggcatcgcccagaaactgaaattcaaagcattacaggagcgggcaaaagaaaaaattgccgacattgccgagagccgcgaactcacggtggcggagcttgaagatcggttagcaccggatctcggtctggatgataatggttcgttgttgctggatttcggcccacgccagttcaccgtcagctttgatgaaaccttaaaaccgtttgtgcgtgacgcttccggcagtcgtctgaaagacctgcccaaaccaaacaaaagcgatgatgaatcacaggcgaacgatgcggttaaccgctacaaattgctgaaaaaagatgcgcgtaccgtcgccgcccaacaggtagcaaggctggaatccgccatgtgcctgcgtcgccgctggtcaccggaaaactttcagctcttcctggttgagcatccgctggtccgccacttaacccgccgtctgatttggggcgtttatagcgccgaaaaccagctactggcttgctttcgcgtagcggaagataacagctacagcaccgctgacgatgatcttttcaccctgccggaaggcgatatctctattggtattcctcacgttctggaaatatcaccgacggatgctgccgccttcgggcagctttttgccgactacgaactgttaccaccgttccgccagcttgatcgtaacagttacgcgctgacagaagccgagcgcaatgccagcgaactgacacgctgggcaggcagaaaatgcccgagtggtcgggtaatggggctggcaaataaaggctggatgcgtggtgaaccgcaggacggtggctggatcggctggatgatcaaacctctgggccgctggtcgttaatcatggaaatcgatgaaggttttgcggtcggcatgtcgccagccgaactcagtgccgagcaactcttaagcaagctgtggctatgggaaggcaaagcggaaagctatggctgggggagtaattcaacacaggaagcgcagttctccgtactcgatgccatcaccgccagcgagctaattaacgatattgaagccctgtttgaataaggaaagagcatggacaaggaattaccgtggctggcggataacgcccaactggaactgaaatataaaaaaggcaaaacaccactcagccatcgcaattggccaggcgaaccggtacctgttatcactgaaaacatcattcagacactgggtgatgaattgctacaaaaagcagagaagaaaaaaaacattgtctggcgttatgaaaacttttcactggagtggctgtccgccatcacgcaggccatcaacttgatcggcgaacacaaaccctcaatcacggcccggacaatggcggcgctagcctgtatcgcgcaaaatgatagccaacagttactcgacgaaatcgtccaacaagagggactggaatatgcgactgaagtggtgattgcacgccagtttattgtacggtgttatgagagtgatcctctgctagtgacattgcagtatcagaacgaggattatggctatggttatcgagcagaaacctataacgaattcgatctccgactgcgtaagcatctctctctggcagaggaaagcagctggcagcgttgcgccgacaaactcattgccgcactgccaggactaccccaagctcgccgcccttttattgcgctgatcctcccggaaaaaccagaaatcgccaatgagttggtaggccttgaatgcccgtggactcattttcattctaaggagtggttaaaagttgttgctactgaccacagggcagtgggaaaactcgaacgctactggagccaggatatatttagcgatcgcgaagccagctacatgtcgcatgaaaaccacttcggctacgcggcctgcgccgcccttttgcgcgaacaaggaattgcagccgttccacgcctcgcgatgtatgcccataaagaagattgcggtagcctgctggtacaaattaaccatccgcaagttattcgcatcttgctgttagttgccgataaaaacaaacccagcctgcagcgtgtggctaaatacagtaaaaactttccccatgcgacgctcgccgcactggcagaactactggcgttaaaagaatcccctgcgcgccctggttatcctatcatcgaagacaaaaagctgcctgcacagcaaaaagcacgtgatgaatactggcatacgctgttacaaacgctgatggcatcgcagccacaactggcagaagaggtgatgccgtggttaagtacacaagcccaggcagtggtgaatggttatttatcggcatcgccaaaaccggttattgatagcaccgataacagcagtctgcctgaaatcctcgtttcaccaccgtggcgtagtaagaaaaaaatgacagctccacgtcttgatttggcatcgctcgaattaactccgcaagtttacttgcaaccaggcgaacgagagagacttgccgccacagagtctgcccgttatttcagcacgggatcttttacggaacgcatggaacgaaaaagtggtcgagttgtactacaggagctaggtcttggggatgatgtatggctgttccggaattatatactccccggaaaactggatgctgcacgcaattcactcattgttcagtggcattactaccaggggctggttgaagagatcctgaatggctggaactccccggaagcacaattagcagaacaggcgcttagcagcggtcacgtagaagcgttaattaacatatgggaaaatgacaacaactcacgttctcgtccggaaaagagtgtctggaacctgtatttattggcacagtcgccgcgtgagatggctttgactttctggctacgtatcaatgagaaaaagcatctgttcgcgggtgaggactattttctcagtatcctcggattggatgcgctaccaggtctgctgttggctttttcacatcgtccaaaagaaacatttccattaattttaaatttcggcgcaacagaactggccctgcccgttgcccgcgtctggcgacgtttcgcggcgcagcgtgatctggctcgccagtggattttacattggccggaacatacagctactgcacttatccctcttgtcttcaccaaatccagcgataatagcgaagctgcattacttgccctgcgtttactttacgaacagggacatggcgagttactgcaaaccgcggcaaaccgctggcagcgtacagatgtatggcctgccctggagcatttacttaaacagagtccaatagagatttacccggcacgcattccaaaagcccctgatttctggcatccgcaaatgtggtccaggccgcgcctaatcattaataatcaacttattaccggtgacgctctggaaattatcggcgaaatgctgtgctttacccagggcggacgtttttatagcggactggaacaactgaaaacgttctgccagccgcaaacgctggcagcttttgcctgggagctcttcaccgcgtggcaacaagctggtgctcccgcaaaagacaactgggcatttctggcgttaagtctctttggcgacgaaagcacggcacgggatctgacgacacagatcctcgcctggccacaagaaggcaaatctgcccgtgctgtcagtggtctgaatatacttactcagatgaataatgatatggcactgatacagctgcatcatatatcgcaacgggcgaaatcccgccccttacgtgataacgcggcggaatttcttcaggtggtcgcagaaaatcgtgggctaagccaggaacagttagcggacagattagtcccaacactgggtcttgatgatccgcaggcgttgagttttgattttggtccacggcaatttaccgttcgctttgatgaaaaccttaacccggttatctttgatcagcaaaacgttcgccagaaaagcgttccccggttgcgcgccgatgacgatcaactgaaagcgcccgaggcactggcccgactaaaagggctaaaaaaagatgcgactcaggtgagcaaaaacctgctcccgcgtcttgaaactgccctacgcaccacccgacgctggtcgctggcagattttcatactctgtttgttaatcatccctttacccgcctggttactcagcgattaatatggggcgtgtatccggcaaatgaaccgcgtcgtttactcaacgcctttcgtgtggccgcagagggggagttctgcaatgcacaagatgagccaattgacctgcctgcggatgctttgattggcattgcccacccgttagaaatggcagcagaaatgcgcagtgaatttgcacagctttttgccgattacgaaattatgccgccttttcgccagttggcacggcgcacagtgctgctcacgcctgacgagtcagccagtaatagtttgaatcgctgggaaggtaaatctgctaccgttgggcaacttatgggaatgcgatacaaaggctgggagtcaggctatgagaacgcatttgtctatgacctgggcgagtaccggctggtccttaagttttcatccggttttaaccactacaatgttgatagcaaagcgctaatgagcttccgttctcttcatgtataccgtgacaataaatctgtcacttttgccgaacttgatgtgtttgatttgagtgaagcgttaagcgcacccgacgtcattttccattaaaacacagcgggcagtgatgcgactgcccgttattaacacgacctgccaccgggaaaagcgatgatcgtgcaaaaagagctggtcactatttacgattatgaggcccctgtacctgaagagccgttttccttcagacttgagatccataaatgctctgaattatttacaggttccatctaccggctggagcgattccggctacatccaacatttcatcaacgtgatcgagaggatatcgacccgctaataaatgatgcgttgatttatataagagatgagtttattgatgagcgaaaattacggggcgaatcaccagaaacggtaatagccatttttaatcgtgaactacagaatatattcaaccaagaaatagaaaaatagctttattaaagggggaaacggtattcccccttagatgcgtttcaatttgcccgttacttcaacaaatcaatcaaccgtaacagagccactaatagctccagtacggcaatgagcacggttaacttttgtgtcagcgtgtccatccgctctccttattaaggagcgcaacaccagcaccttacccttacactgcctgtcgatactggtttacgtatgttggaccacgatgttgcactccggatcagggcactacctgcggcaccacccgtccggtagccaggacttgaaatgggttcgatccggcgcaacgtcccaacagtcaggattataaatctcattatcttaattgcaacggggtccaccgatggttataattcgttcgttggaacacgatgttgcacaggccgtggtgttaggcctgaaagtagtaaataaaagaacctgcctcaccagcaggtttttttatttactgtgatctgctttccagatatttttcgctcaaacaactaatgcgccaaacatttattgcgcgtaaaatatcgtttatttcattaatacatttcagggatgaatatatgtcaccgcagaataatcatctgcagcgtccgcctgccgctgtgttatacgccgatgaactggcaaaattaaaaaaaaatgatcacgcaccttgcccgcccggttggcagttaagtttgcctgcggcccgtgcttttatccttggcgatagcgcgcaaaatattagccgtaaagtggtgattagtccctccgctgtcgaacgtatgttagtcactcttgccaccgggcgcggtttgatgttggtgggggaacctggcaccgcaaaatctctcctgtctgaattactggcaaccgctattagcggcgatgccgggttaaccatccagggcggcgcatctactactgaagatcaaatcaagtacggctggaactacgccctgcttatcaaccatggtccgtcaacggaagcactggtccctgccccgctttaccagggaatgcgcgacggcaaaatcgtccgttttgaagagataacgcgtacaccgctggaagtacaagactgtctgttaggtatgctttctgacagggtgatgacggtgccggaactcaccggtgaagccagtcagctctatgcgcgggaaggctttaatattattgccactgccaatacgcgcgatcgcggcgtcaatgaaatgagtgccgcgctaaagcgtcgcttcgattttgaaactgtctttccgattatggatttcgccctggagctggagcttgtcgccagtgcttcggcgcgtttgctggcccatagcggcattccgcataaagtgcctgacgcggtactggaattactggtccgcacctttcgcgatctgcgtgccaacggcgaaaagaaaacgtcaatggatacactgacagcgattatgtccaccgctgaagccgtgaacgtggcccacacggtgggcgtccgcgcctggtttttagcgaatcgcgcaggtgagccggccgatctggtggactgtattgccggaaccatcgtcaaagataacgaagaagatcgcgcgcgcctgcgccgttacttcgaacaacgtgttgctacacataaagaagctcactggcaggcttattatcaagctcgccaccgcctgccgtgaggaaagatgtatgagcgagccgttaattgtcggcatccggcatcatagcccggcctgcgcccggctggtgaaattgttaatcgaaagccagcggccacgatacgtattgattgaaggcccggctgattttaatgaccgggtggacgaactgtttttagcccaccagcttccggtagctatttacagttattgccagtatcaggacggtgcggcccccgggcgtggtgcctggacgccatttgctgaattttcgccggagtggcaggcgctacaagccgcacgtcgtattcaggcacaaacttacttcatcgatttgccttgctgggcgcagagtgaagaagaagacgaatcacccgatacgcaagatgacagccagaccttactgctgcgtgccacctgcatggataacagcgataccctgtgggatcacttattcgaagatgaaagccagcaaactgcattaccctctacgctggcgcactattttgctcaactgcggagcgattcccccggagatgcgctcaatcgtcagcgcgaagcctttatggctcgctggattacatgggcgatgcagcaaaacaatggcgacgtgttagtcgtctgcggcggctggcacgctcctgcactggcaaacatatggcgcgaatgcccgcaggaaattaacaagccagaattgccctcgctggcagatgccgttactggttgttatctcacaccctacagtgaaaagcgccttgatgtgctggcaggatacctttccggaatgcctgccccggtctggcaaaactggtgctggcagtgtggcttacagcaggcaggtgaacagctgctgaaaacggttcttacccgtttgcgccagcacaaattgcccgcttctaccgctgatatggctgctgctcatctgcatgctatggcgctggcacagttgcgcggccatacactacctctacgcactgactggctggatgccatagctggctcgctgattaaagaagccctgaatgcgccgttgccatggagctaccgcggagttattcatcccgataccgatccgattctgctaacgttgatagacacattagcgggtgacggattcggtaaacttgccccttctacgccacaaccgcctctgccaaaagatgtcacctgcgaactggaacgtaccggaatctctcttccggcggagcttaccttaaatcgctttacccccgatggactggcgcaaagtcaggtgttacatcggttggcaatactggagatcccaggggttgtgcgccagcagggaagtacgctgacacttgcaggcaacggtgaagaatgctggaaattaacccgcccgcttatccagcatgcggcattgattgaggccgcctgctttggtgccacactccaggaagccgcacgccataaattagaagccgatatgctggacgcgggtggaatcagcatcatcactgcatgtcttagcctggcagcgttagcgggtctggcgcctttcagtcaacaattactggaacaactcacattattaatcgcccaggaaaatcaattcgccgaaatgggccaggcactggaagtgctatatgccttatggcggctggatgaaattagcggtatgcaaggcgcgcagatattacaaatgacattatgcgcggccatcgatcgcacgctgtggctatgtgaatccaacggcagaccggatgaaaaggagtttcacactcacctgcatagctggcaggcgctttgccatatcctgcgcgatctacatagcggcgttaatttacccggcgtttcgctttctgcggcagtagccttactggagcgccgcagtcaggcgattcatgccccggcgctggatcgcggcgcgactcttggcgcactgatgcgtctggaacatcccaacgccagtgccgaagcggcgctgacgatgctggcgcagttatccccggcacaatccggcgaggcgctgcacggtttgctggcattagcccgtcatcaactggcctgtcagccggtatttatcgccggtttcagcagtcatttaaatcaactgagtgatgccgattttatcaatgccctgcccgatttacgcgcggcgatggcctggctaccaccacgagaacgctggacgctggcgcatcaggtgcttgagcattatcaactggtgcaacttcccgtttcggcactgcaaatgccgttgcattgtccaccacaagacattgcacatcatcaacaactcgaacagcaggcactggcatcgctgcaacactggggagttttccatgtctgaactgaacgatcttctgaccacccgtgagctacaacgctggcgattaattcttggcgaagcggcagaaacgacgctttgtgggctggatgacaacgcccggcagatagaccacgcgctggagtggctgtatgggcgcgatcctgaacggctccagcgtggtgaacgttacggtggattaggtcgttcaaatctcaccacccctgagtggatcaacagcattcacacgctgtttccgcaacaggtgattgagcggctggaaagcgatgccgtgctgcgctacggcattgaagatgtggtgacgaatctcgacgtgctggaacgtatgcagccttctgaaagcctgctacgcgccattttgcacaccaaacatctgatgaatcccgaagtactggctgccgcccgccggatagtgcaccaggttgttgaagaaataatggttcgactggcaaaggaagttcgtcaggctttttctggagtacgcgatcgccgtcgccgctcatttattccactggcgcgaaactttgatttcaaaagtactctgcgcgccaacctgcaacactggcacccgcaacacggcaagttgtatatcgaatccccccgctttaacagccgcattaaacgccatagcgaacaatggcaactggtcctactggttgatcaaagcggatcgatggttgattcggtgatccactccgcagtgatggcggcctgtttatggcagttacccggcattcgtacccatctggtcgcttttgacaccagcgtggttgatctcacggcagacgttgccgatccggtagagttattaatgaaagtacaactgggcggcgggaccaatatcgccagtgccgtggagtatggtcggcaacttattgaacaacctgcaaaaagtgtcattattctcgtgagcgatttttatgaaggtgggtcatcatcattgctgacgcatcaggtgaaaaagtgtgtccagagcggcatcaaagtgctggggctggcagcgctcgacagcaccgcaacgccttgctatgaccgcgatatggcccaggcgctggttaatgtcggcgcacaaatagccgcaatgacaccgggcgagctggcttcctggcttgcggagaatcttcagtcatgaattcactacgtccggaattattagaactgacgccgcaggccctgacggcgttaagcaatgccggttttgttaagcgcagccttaaggaactggaaaatggcaatgtcccggaaatcagtcatgagaacggcgctttaatcgccaccttcagtgacggtgtccgtacccagctggcgaacggccaggcactgaaagaggctcagtgcacctgcgaggccagcggcatgtgccgtcatcgcgtgatgctggtgttaagttatcaacgactttgtgccaccgcccagcctacggaaaaaaaagaagaagagtgggatccggcaatctggctgaaagaactggctaccctgcccgatgccacccgcaaacgcgcgcaggcgctggtcgctaaaggcatcaccattgagttgttctgtgcgcctggcgaaattccctctgcccgattaccgatgagcgatgtgcgtttttattcccgcagcagcattcgcttcgcacgctgtgattgcattgaaggcacactttgcgaacatgtcgtactggctgtgcaggccttcgtcgaggccaaaactcagcaagcggaatttactcatttaatctggcagatgcgcagtgaacacgtcacatcatctgatgatccgtttgccagcgaagaaggcaaaacgtgtcgtcaatatgttcagcaattaagccaggcattatggctgggcgggataagtcaaccgccaatccattacgaggccgctttcagtcgcgcgcagcaagcggcggaacgctgcaactggcgatgggtgagtgaatcgctacggcaattgcgcgccagtgttgatgccttccacgcccgtgccagccactaccatgccggagaatgcttacgtcagcttgcggcattaaacagtcgattaaattgcgtacaagagatggcgcgacgcgacagtatcggtgaagttcctcccatgccgtggcgcacggtcgttggcgctggtattgccggagaagcaaaacttgatcatctgcggctggtgtctttaggtatgcgttgctggcaggatattgagcagtatggtttacgcatctggtttaccgatcccgacacaggaagtattttgcatctttcgcgtagttggcagagaagcgaacaggaaaactcaccggcagcgacgcgtcggctgtttagttttcaggctggcgcactggccggtgggcaaattatttcacaagcagcaaaacgcagtgccgatggcgagctgctgttagctacccgcaaccgcttaagcagcgttgtgccgctgtcgcctgatgcctggcaaatgttgagcgcaccgttgcgccagccgggcattgtggctttgcgggaatatttacgccagcgtccccccgcctgcatacgaccaatcaaccaggtcgataacttatttattctgccgatagcggagtgtatttcgctcggttgggatagcagccgccagacgctggatgcgcaggtaatcagcggcgaaggggaagataatgtgctgacgttatcccttccggcatctgcctgttctccttttgccgttgaacgcatggcggcgcttttgcaacaaacagacgaccccgtgagtctggtttctggctttgtcagttttgtagaggggcaattgacactggaaccacgggtgatgatgacaaaaacccgcgcctgggcgctggacgcagaaactgcgcctgtggcaccgctaccttctgccagcgttctgcctgtgccgcctaccgctcatcagttgctgatgcgctgccaggcgttacttattcaactgctccataacggctggcgctatcaggaacagagtgctattggtgaggcagagttgctggcgaatgacctcaccgcggtgggtttttatcggctggcacatgtgttgggacaatttcgtaatacagaaagcgaggcacgggtagaagcaatgaataacggtgttttgctttgcgaacaattattccccatgcttcagcaacaaggatgaaatagtgctttttattaagagttctactcctgttccggactgctcacgccacagtattaggcatatcctatatagcccctggtgagagtcaccagttccttgattaaataaaatggagttttacatgaaggctttcaataagctgttttcccttgttgttgcatctgttctggttttctctcttgctggctgcggtgacaaagaagaatcaaagaaattcagcgccaatctgaacggcactgaaattgccattacctatgtctacaaaggtgacaaggtgcttaagcaatcttctgaaaccaaaattcaatttgcctccattggtgcaaccaccaaagaagatgccgccaggacacttgagccgttaagcgctaaatacaaaaacatcgcgggtgttgaagaaaaattaacctataccgatacctacgcgcaggaaaacgtgactattgatatggaaaaagtggattttaaagccctgcagggtatttcaggaatcaacgtttctgctgaagatgctaaaaaaggtatcactatggcgcaaatggaactggtgatgaaagccgctggttttaaagaagtgaaataatctgtcggcggccatgtttcgcatggccgccatacccgtcttagcttttcttcacatgctggcgcgctgccagtccacgcagaaaataacgtaaaaattgatcgccgcattcgcggaagtttttatgatccggtgcacgcatcatcgccgtaatttccggcatcgaaacgcggaactgctgttcggtgaggattgccagaatgtcatcggttttaagcgaaaacgcgatgcgtaattttttcagcacgatgttgttattaatgcgacgttccggctccagtgccggagcagactcatccttgccgcgtttttcataaatcaggccattgaggaatgaagacaaaacaatgtccggacaacgctgaaaaccctcttcgtcttctttacgtagccagacggcgatctgttccgcggtggcttcgacattacccagcgccagaatacgcaccaggtcattattattggctttcaaaatgtagcgcacgctgcgcagaatatcgttacttagcatgaggccttcaggtgttgatgaggcaaaaagccattttagcagtcttttacaggccaatcgcctcttttaagcttttcagataacggcggctgaccggcacggttaagccattacgcaaaatcaactcggcctggccgttatcttccagacgaatctcctgtaaatgcgcgaggttaaccagatactgacgatggcagcgcagtaatggtgtacgactttccagggtacgtaatgtcagttcggtaaagccctctttcccttcgtgactggtaacgtagacaccgctcatccgactgctgacaaatgccacatctttcatttgcagcaaataaatccgactatgccccgtacaagggataaatttcagcgcctgttgattttccggtaacagcgaaacatcctgcttgctgcgctcctgacgcaatcgcgccagcgttttctccagtcgcacttcatcaattggcttcagcagataatcaaaggcatgttcttcaaaggctttaatggcgtattcgtcaaacgcggtgagaaaaacaatatacgggcgatgttccgggtcgagcatccccaccatttccagaccactgatgcgcggcatctggatatcgagaaacagcacatccgggcgcagtttatgcaccgcgccgatcccttctacggcgtttgaacactctccaacgatttcaatatcgctctgctcctgcaaaaatacgcgcaggttctcccgtgctaacggttcatcatcgacaattaagactttaatcatgcctcgtccctccatggtagtcgtaacgttattcgggtgtaactatcaggctcacaggcgacgcttatcccatagtcatcgccaaaccgttcacgtaaacgcttatccaccagattcatccccagcccactggcattggttaccggttgatacaaacctgcattgtcttcgatctccagcatcaaatgttgcccctcacgtcgggcgctgattgccactcgccctgtatccagcagttgtgatgtcccatgtttaatggcgttttccactatcggttgcagggtaaacgcgggcaattgctgctgggataattcttgcggaatagcaatgttgacctgcaaccgcgactggaagcgcgccttttcaatttgcagataagcgttcacatgttcaatttcgtcggcgagagtaacaaactccgaaggccgctttaagtttttgcggaaaaaagtggaaagatactgcaccagctggctggcctgttcgctgtcgcggcggatcaccgctttaatggtgttaagcgcattaaacaaaaaatggggattcacctgggcgtgaagcagtttgatctctgactgggtgagcatcgctttttgccgctcatattgcccggcgaggatctgcgccgaaagcagttgcgcaatcccctcgcccagcgtgcggttgattgaactgaataaacggtttttggcttcatacaatttgatggtacccatcactcgctgattttcaccacgcaacggaatgaccagcgtcgaccccagtttgcattgcggatgcaaagagcaacggtaaggcacttcgttgccatcagcgtagaccacttcaccggtttcaatcgcttttaaggtataagttgaagaaatcggtttgccgggtaaatggtggttgtcaccaattccggtaaaggccagcaatttctctcgatcggtaatcgcgactgcaccaatatccagctcctgatacagcacctgtgccactttcatgctgttctcttcgttaaacccctggcgcaaaatgccttccgtcgaggccgccactttcagcgcagtggcagaaaaagccgaagtgtatttttcaaacatcgcgcgtttatcgagcaatatacgcataaacagtgccgcgccgacggtattggtgaccatcattggcgcagcaatattactcaccagacgcaccgcatcttcataaggtcgggcgatcgccaggatgatcaacatttgcaccatttcagcgacgaacgtgacggcaccggcggtaatagggttaaagactttatcagtgcgcccgcgacggatcaggatgctgtgtaccaggccgccgagcaatccttcaacgatggtcgagatcatgcaacttagcgcggtcatgccccccatcgaatatcgatgtaacccgccggtcagaccaaccagcccaccgacgaccggaccgccgagtaagccgcccattaccgcgcctatcgcacgggtattggcaatagaatcgtcaatgtgcaacccaaaccaggtgcccatgatgcagaagatggaaaagacgatgtagcagagaaatttatgcggcagacgaaccgtgacctgcattaacggtatgaataatggcgttttactcattaaccacgcaatgactaaaaaaacgcacatctgctgaagcagcagcaacaccagattaaaatcgtacatacccgcaaaccacacttccctttaaaatgcgtaacatacattgcttgcgtttaactttctttgaactcttgcagaaaaatgagaattcgtgagtacgatcactcaaaatcgcctggcaaaaataaaatcaccctatagatgcacaaaaaacgggcaaaactacctggttcgcaaaactgcgtctaaagttaaaccgggacctcgcgagcaagggtgagacgatggcgctttacacaattggtgaagtggcgttgctttgtgatattaaccctgtcacgttacgcgcgtgacgcaacatttttaaaaatcgacgaagatcgtccaggagcgccgtttttcaagggttggatagatgattcgtttaccatgtcgacgaacttcgacgaatttcgccgataaaaagtgtcccatacatgccccattgatgccccataaacaatatcaggaattgacactggttatccatacatacaaaaataacacctgtacataaccacagttacaggagggtgttatgcgtgttgagatctgtatcgctaaagaaaaaatcagcaaaatgccaaaaggttctgtttctgccctgcagcaagaaatgcttcgacgtgtcagtaaacgttatgacgatgtggacgtgattgtcagagccgccaacaatgacagtctcaccattttaagagctgtagataaagaatccgcgcacgaatttgtacaggaaacactgcaggaagcctgggaaaccgctgacgactggtttattcaataacgcaatcataatcacggcaataacatattttttatgactttatccgtcccgcatgacataacaactatctggtagttataagttgcttcttctggttggggagtcggaaaactccccctttctgatcatcctgttttacccgcttaaccagcaacctgcctcagattcacaagtcactttttgtatggtataaaccggcgctttaatacaatttacagccctggcattttctggcggagagtgcgaaactcccttttttacggcatttctgtcggaactcatatttttcctgcatatctgacacttgcgtattttcatggaaggagatcacccaataaccccgatctccttcatgttaatacgcagtcagaatgaataacggaagccggcgttgacagcattatcaacgttgtacttaccaaaggctgatttctcaaactccagaccaaaacggatgttgtcacggacctctgcgttcagccccacagacatcagcatacggccgtctttctcgcccttgatacgcttctctccggatgcatcacgcagtaccgtttctccgttcgccagcaggtcaaactggtagccaagaccggcacgtgccgtcactttccagtccttaccggagaacgatttacccacatccacaccggtacggccaatcagcggattgtagtccttgtccttcatggacaggctcatcccctggtccttccagctgaactgtttcccggagacagcaccgtaaacaagttccgcctgtggctcaatccaggcatcctctgtgacatgatagcggtaacccacttcagcaccggcataccaggaatgagagccgtagtcttttgtgccgagtccggcaaaggtcgccgtatactcattatcatggtgaacatacttaccaatcaggtcgatataggccccggaatcaaacagggctgaagcatacagacccgcccccactgacttcgttttaccactgaaggtgtcgctgccggcgttgctgtcggtatatgtcatggtcaccccggtgaagaggtccagaccgtccagttcgtgttttttatccgcacccacctgaacgtgtgtgtagttgtcactgaagccaccaccggcagagccggttccgctcatgatacgggcccatgcaccggcctcgccgttgatgtcccgcaggtcacccatacgtttgttcaggttgttgacctcattaatgaagttacggtgccccattgacatcagcatcccggcatccctgaccgcagagacattaaccgtactccggtatcctgtcagcagccaccgggtctcatcacggtactcacctgattcccccgtattctctccggtcagtacatccgtcactgacgcctccggagccggtgacggagcagaaaccggtgaagggagcggtgatacggcttccacaggattcggcgtctttgcatcctgccgcatcaccaccggcaacgacggcctgctcacctcatccaccacaggctctgcggcagtttccggctgcacaacattcagctgccaggccgtgccgcccgtcccctgttcagccctgacaacaggtgtgatatgactgaagccggtatcacgcgttttcacactgaacacatccgcgccggtaccggccggcgctgtcaccagagggatattcagcgccttcttcccgtcagaacgctcagtaaaatcaaccaacaacagattattcttaccccgcagcgattctgtcacccgaagctggtctgagtggtgaaggtccgtccgcatcaccagaacactgtcgctgatatccatactgcctgccgtcagggtatggaactccccgcccggcctgctgaaatacagagcacttcccgatgactcaagatgcttcacggatgagtttcccgtcatcatccaggccgcattctgcagattcacattacctgcactccctctgacataaccccgcaggagaccagctgcccccgtcataaaatcatactcaccgcttccgttcagcccgccacgcacctctgaccaggccagcagacgttcatacacatcattcctgacacttcccccgtcaaccagaagggttcctccatccagtgtcacaccaccatctgtctccagtccccccttcacatgtaaacgcccgccgtcactgacagtaagtgcagaagacgtcaggcgggaatccccttccagacgcacattctctgagttcacgactatccggccgtccgatgccgttatactgccggtaaaatggtcgcggaccgtcagggaagaatgacgcatattcacattcccgcggaatgtactggtaccggatgcaccgcccgcagcagacgtccccttaaccggcgcactgctgctccccgtgccgtccttcatatccagatacagcgagtcacttcccagcaccatggtggcattatcagcatcaatatctcccgtcagtgtcgcattgcgggaaaggctgaatgacgcttccttcagtttcagttgcccgatgctgaacgtcctgctctcccagtccttctgggtaaatgataccggccgcgtcagaacagaattatcaccctgctttcgcaatgcagccgcaaccgcctcactgctcacggcatgaacaaccggatgcccctggatatacagtcccccgccctgctgtgtaaaactgccggacatatccgctccgccatccatgatgaaatccaccgctgatgacgtgttgttcaggacactgaggttgccggtaaaatgaccatgccacatcacggccttctgccctgacgggctgaaatccagacgaactgtggcagaacccgcccggcttgtgagtactgccccctcatcagccgcagccagccggtggaaggtcatatcattgccgttgatatcaagcgtgcctccccggtatccccagcggatgcggtccccctcaatctgatgactgtcctgcagcaccacaaccggccgtccgctgacaatacggacttcactgaatgcccggaccctgcctgcagcatcagccttctgtgccagaataaccgttccgtcccccgtattcagggtgccaggattttcaccactgccggccaccaccagtgttcccttaccagttttatgaagtgcgtctcccgcaagtccgttcaccatccagtcaacacggtgcccgtcgttcacgatgattcccccgcccacccaggtctgattcccttccggtctgaccgtataatcaccattaaacgtgagcgaacccgccccctggacaacatcatccttcagaacaaccgtgcccttacccccaaaggtgatatctttcccgtcattcagactccctcccctgaagccgttcatcttccataccttcccgtcctgagaaagggttccctctccgcttcccttactgtaattccacacaatgtcaccaccggcaactgccggcacgacagtgcctgaactgtcctgctttatcgtgttattcacatcccctgcgggaatcaccgtaaaccagttcgtcttccctttctcaccggcataaccattaagtacagcaacaaggacccactgcttcttcaccgcatcccaggcaaaaagcggtgagccactgtctcccggtgtcccgtaagatgccagcggaccattgacactctggtacagataccccgggtttgacaccagactccagtcagaaatgagcggacttcccaccgtcccgcccgtcttccaggcgtaagcacccgctattctggtcagcgcaccggaagcagctccggtgtactgcgttccactccccatacgataaaacaccggataacgactgcggttctggtatacccccttgccggttccggcatccgtgacgctcaccggggcaacttctgtcaccagtttgttcagccggggagtatgaaaatcacgccagtgctcattacggtcaacaaggcgatatgtcgtatcatccgcataaccaaaacgcaccgtgttgtagctgccgttatgcttaacccccgccacatactgcggagaaatcagtgttgccacccccagtatctggtccacaacactgaaatccatcatcggcgccttgtccagccgcccaccgacagccccgttcctgccataaagcggaatatttgtggcaccggcatgaaacgcgcccttgttctcagcaaaatccctgtaggtctgccaggggagggtattcccgacaacggatgccagcgacggataagaaaacagaacaccggcaacggcaccagaggccagaagaagacgggaaagcatccccgcaccgggaatgccggacgactttttcctgccgcccgccgtttccgctaccgcaaccagttcttttctgtcattcattctgagagaatatattctgttcattccccggtttccctgtcttttcccggacagcagtcaacagtgacgcctgcccggatatctgttaacgaatctgacgaatactgccgccagattactgaagcaacacagctgccgcggtaaaaagagccaccaccccacccagccacacaaacaacatgaaacacattgcgcctgtggtgtaacgctttctcccgtatctccggtctctgtctttgttcatcatctgcaccttctgaatcatcagaagatgccgcgcatccggcaggaccgccatcaggcaccaacaagccgtctgacactcacaccatacagcccgtttttcgccattcccgtatacagaaaggtattcaccgtctttgtgttaatacccatttcactggcaaggcgacagggtctcgactggcggtagacataaccgaacatcaccaccatctctgacatcgtcagcgggcgggcagcactgttatacgtccagacgccgttgtgtatggcatcacttatctgctcaccatcacgaagcaactccgcatccagttgcagaaaatgacgcccctggaacatacaccgcatcagcctgcccagcaggccatcactgattatcagccaggattcgtcaaagtccgggatataacggcggttctccggcaggaaaaactccctcgccagtatcacactgtgttccttcagcaactgttgcagtccatattccaggtagcggttccttgtggccagaattaccttcatcgcagcaccttcctgtttttatgccccatgaaaaacggcagaccagagtcctgcgcctgccgtcatacttcatgtcaccttcagcaattaaaactcgaagttcacaccaacgttccaggaggcatcgccatcactgaatgccacgcctgctttcgctgcggtctgctcgttgaagcggtaacccacacccaccgccagtgcctgctggtcgctgtaaccaccaaccgctgccgtggcgttgaatttacccacactgtacggctggaacagacctgtcagggccgcagactgtgctgctgctcgtttcatttccttatggttttcattaatctggcgctgctggctgtccagacgtgctgaatgttgctgcagcgtacgggtattggctgcaatcgccttgctgtttttctcaatggattgcgtgttacgggtgacacggccatcaatggcaccaactgctgcatcaatacggtcagtacgaccagacagggccaccagaccatcgttaacagaaatggtgttctttgcaccttctgcacgggtcagggtgccatcagaactcacaccaaccagtgtgcgggattcgacttttgcagctgttgcagcagccgcagcatcaatcttgtcggtacgcgtggtcagtttaccaagattttgcttctgcgcttcaagctcgcctttctgagcatcaagcttgcctttctgagcttcaagctcattcgcaacaatggtggagttggcggcctcccatgccagatagtgctgtaaaggcatgtattcttttatttcactcgaatctgctgccacatttccattctcatccaggccgacgttggttttcatctgctggattgctgaaacgcggttgtacaggtcacggatattctgttctgtcaggggggcgccgttactgctgccaacagtatttgatgccgcagccttcatgaaatcatgaacttctttatcataaacagtaaatgttgttgaaccgtctgcggaggtaattgtaacattaccattaccatctattttactgagaagtggaatcggcttatttcgctctttttccacataacctgacttaccccagtcaatatgcgccgtattattatttttattataaaatattttaaaaacccccccatagccaccgttaccatttaaggcagaataactatcctcgacgacgttatcaccagccataatatcaaagctaaccccaaacaaaacacctgccattgccgcagacaaaacagcctttgtaaatttcttgctcatgtggtataccctataaaattatttgtatacaaataaaacagttcaacatcggatatataaagaaaatctgatgtctcgccgctctcatgagcttactcctgaagaaattccgaattttaatatgaagtttatcggaatttccttactataacgtcggtgatatcacgttcgcgaagggatatccgcattacgactggcctgccacttatgctgtctctttattcatcaacaatttgtatacggttacatatttaattgtgaagttagtcacaaaaagaagaaagtcaaataatcaaattgtgcttaactgtttacatcagcacaatctgatgaccattgaaggacgcactaaattattttcagcaatccctcagcctacgaaaattctgtatttgatgattgttttatttgctctctttttatgcagccattctgttgcttataaaaaagcaccactatccgcgccctcatctcaatatctttgtcgccggataaaaataactatcaaccacaagtatcatgctctcggggagcgcgcactcccccactttttttatccctgacagggtcaggaggccgttgcatctcctttaattatcattgccagattatttcctcgacctgagtattctttatttagccatagctttgtagcaaggggctggagcgcccctctttttttcacctgtcagccatgccgaccttatacgccagtatagcttccgcatcatccagcgcttcaatctcttttttcatcgtgcgctgtctgacatgaatttccagacctttggtaaacatcgcctgctctgcagcagcactcagagcaatcagtgtttcagcgtccatcggtacgtcattattgtccgcatccgtccagaaaaacgcctccggcagtattcctgctttcgcggcagccactgacggctcaagacgcgcctgtgtctgtttgccgtagtcccatttacgcccattgtgctcaaacgtgtagttcgccgcttccatcgcattacgccaggcgttgatcccggcggttttgagttctctggctttttccgggctgatggatggctgtacatattctgcaatttcaccggcctctcctctcagacaagcggcataaatatcccgcccgtatgcttcggtatcgctggctgttgcagtgaaaggaaccgcctgctcaatgtgctcaaacttcaccatgcaattgacagcagtgtgctctttatctgcccattgcggattgcttattttttccacattcatgttcatctcctgtctgtcagtatgcgcgctggaacagcccgatgccttcattgtcatttgtcgacgtaatttcattacacaccatccatgaccccggaactgaggataggttgccgtcaatgccatcggtgttagctttcatatagtttccgttttcgtctttgattagggcgcatcgcttaaggcgtgaacccgatacagtttctcctggctgataggttctgccgatgtcggttatatacgggcctagtgcggcaataatgtatgttccgatgctgtaaatttccccgggtaccagccttccggttggcccttgtggtccctgtggtccctgtggtccggttttaccatccaacccgggcggtcccatcggccctcgccctccggcagggccccgtggccccggaacaccctgcgcccccgctggtcccctttcacctcgtggccctgccggacctgccttaccttccgctccggcggtaccatcctttcctgcggggcctgcatcacctttgggaccagctgcaccagccggtccccgtgggcctgcgggccccactgcaccaggtgcgccaggttcccccctgtcccccttcggtccggggactgctgcccgggttgctgcctcttctgccttcgtttttgctgcctgcacttctgccattaccgctttcacagcctttggggttgccgcttttgtttcatcatcgctgttggtatcgctgctcagctgtacaacacctttctgtgatgtgctggcatccggaacactggcgacactgcctgcgggacccgcaggacctgttgcgccgggttcacctttatcccctttcgggccggtttgccctgccggaccctgtggtccgggtggtccgggtggtccggcctctccacgtgggccggtgtcacctttcggccccggcggtccgcccgggtcacctttatcgcccttcggtccctgtggacctgtttctccccgttctccctttggccccggctcaccttttggtccgaccgcccccgttgccccggctggtccctgtggccctgtggcaccctgtggacctgtgtcccccttctcgcccgccggtccccgggcattctctgcccgtttcttcgcttcctctgcactcgccgccgacgcttcagcacgcttcaggatttccgctgccaccgcttccagctctgcaagcgctttcgggtaatactgcgcctcatcctgttccatcagaaatttattcagcgttcccggctcagaatccgccttcaccagaatgtcacccacatacgacggggcgtacccttccgtgttcagcgtcacccggtaccaccccggctccacatcaaaactgtaactgccggtttcccccggctgcccctgcgccaccgtggtgactatcactgtctctgtggtgcgtcgcgctttcagctctatggtgcatcccggcaccggcttcccggtgccgtccttcagcacgcccgatattctgactgtcatagatttctcccataaaaaaaaccgcagtaccggttacccggtctgcgatcaggggtataaattgtgactggctggtgttaaagggtgccgtcagtcaaaggcacccgtggataatgtacgatgtccggcttttgtcgttttccggcaatcacgaacagatggatgaaacctcactatccacctgtcacgatgcggtatcaaaatcgtctgtataggatttcaggtaaaacagaaccgggtccgggatccgaatttgactcgtatcatgaagtattgaaccacccctgtaaaaaagcacacctgcttcatacctgaatgtaatttcaacccgcgcatcaccctgtccggcaggaataccccatgagcctgacgcacttccgccaacatcagaatataccggctcatatctgctggcgtttttggaaatctggacctcccgctccccggttttgactttgcctgacctggcatgaacgacaactttgtcatttatcttcatgatgaattcacctctggaaaatgaatacgccataagcataagcttgcgatcaaacggcatgttgtctttcagcaaaatcattttctgaaaagtcagctggttctgagtcattacgccctgccccatatcaaccgtgtatcccttgacgatatcaccaatgattcggtcagcgctcatcgttccattaatggtgcagtcttccgcaatcgtcacgttattcagcgtaccggaactggcactgatattcccgctgatatcggcattacgggccgtcagcctgccgtccggcgtcagggagaatgccgggggattgccgccgctggtaatggtgggggcggtaagaacctttatcagggcctcattgataaacgtctgtcccccctgcgtgaccagtgcgggtgtggtatcaccattctccggattaatgaatgccacacggtccgctgccagcagtatctggctctgcatcccgtcaggggtgttctcaataccggcaccgataccggcaatatagcgacgaccatcctgcatctgctgtagcttcaccgcccacatgctgttcaggtcattatttgtgtccgtctgcacacgctggatttgctgtatggtggcgttctggtcctccagcgttttactgaccgtctgcgtgatttcattgcgggtttcggtgatggtggtctgcatttccgccatctcgtccttcagctgactgttgtcaatctctgcccacagcgcctctgccagatgcgtttttcctatcttttcccggaaaagttccagatagcccgcagcatcattgctcgcccgtccactggcttccacaaaagcagatttacccaccaggttgacgctgcgcacataaaaccagaaatcctttccgggcttaatgtgcggaccggagacactccactgactgccggtccccagataacgggcagaggtttccacctgtgcggcgtctgcaatttttgcctccgaaaaccagaactcaaactgcaccgtcgggtcataaatggtcagtttcgggactgccgttatctgaaaataccccggcgtcagttcaacaccggcaggcgctgccggtgcgttaatccggaacgtggtggtggcgggttcgccctgctggccatagctgttaatcgccctgaccgtcagggtgtattccccgagaggcaggccactgaaacggtgctccgtatcggcagtgatggcggtggtcagcaggcggctgttctcaccgcttccactggtcaggcgcagactgaagcgcacgcccttcaccacccgcggcgtgtcccatttcgccagcgccagatactggccgtcagctgcgctcacctccaccgtcaggtgctgcactgccggtgggataacgctgttcagggtgcctgactgcggctcaaagcgggctccgttatccacaatggcttctttttccggtacgtgctgcaccgccgtgatggcaaaggtgccgtccgtgttttcccggatggccacacagcggaacaggcgacggcgcagtgacggcagggagagtccccacaccccgtatgtctccacaccatcaggcagggtactgacctgtatccggtccggcgcggggtgtgcggtgatgtccacactcaccggcttaccgctgccgttaatcaggttcaccgtcgatgcacctgtccccggaagtgtcacttcacggtccagcgtcagggtgcgggtggcagcatcgatggacaggacacgtccgccggtcagggtcccggcatagtcgttatcacagatttcaataatgtcaccgggtgtgtgccgcagcccctgagacccgagtgtgaaatccaccgtctgcgtttccagcagttcggtctttatcacccacagcccggcacggtgggcctgaccgcggctggtacagccgaacgcgtccatcttcagcaggttgcgtccgtagcgcagtatggcttccgggtcttccaccagttccgtggaggtctgccagccgttctgcgggtcggtgtaattcacctccaccgccgtgtgccggtccttcagggcactgaagctgtagcggaaccccacgccgttatcatccaccaccacatcgctgttggtgtacggccacaccacatccgacgggcggtcctgaacgaacgtcagcgtctggccgttccataccggcatacagcgcatcgccgagcagaaatcactgagaacgtcccacgccttacgctgttgtgccaggtacgcattaaaggtcatccgcggctctgtgcccccgaatccatccgggaccgtctggtcgcagtactgcccgatggcatacagcgcccacttgtccacatccgccgcccccaggcgttttcccatcccgtagcgcgggtgagtcagcatgtcccacaggcaccaggccgggttgttgctgtatgccggtttcagactgccgtcccagataccactgtacgtgcgtttttccgggtcatagtttgacggcacctggatgatgcgaccgcggatatggtagttcaccgtcatctgctggccgccgaactgctccgcatccacctgcagccccacaatggccgtgttcgggtagcactgtttcacatcgatgatttcggtgtatgacgaccagagcgtcttattctgcagctggtccgtggtgctgtccgccgtctccctgaccatccggatgttaaaggggcggggaggcagattatccagaatcaccgacgcaaggaactgtgaggtggtcttgccgttaatggtgacatccttttccgtcacccagttaccgttacgcagtaactgaatcagcagacggacagaggacggattacggtcaccctttgacgtggtctccaccagtgactgcaccccgaaggtcacccgcaggcggtcaatgttcgctgacgtaatggtgcgtgtcaccggttttgccctggtcacttccacacccagtacagtttcagagccggaggactcaaagccttccggtggtgtctgctcctgctccccggcgcgccagaccgcggtcacaccgtgtatcacgggattaccgtccgtgtccgtcagcggggttttgttcaccagaatactctgcaggcctttcaccggaccttcaatgggtccctcaccaatcgcatcaatcacgctcatcatctgcgtggatttgaggttgtctttcgcctcacgcggtgtgtgcgccctgccgccacctttgcccattacatcacctcttaccgtgataattgttcactcacaaaaacaacaggcacctcaccgggtgcctgcgtcatgacggaataaaatttctgaatatcttcacattttcacacactgactgtggcgcttataatttcgctgcgttagttttttttgcccgagtaacaaaaacaactccttaacattaatcttcatttgtctgtccccgcagctccgcgatcactgcgggatttttttatgttttatccctgtcgaccaataaccaccacctttccgcccccgccttcatcacgggtgctgatgtcctgagagatacgtcgtgaaccaaccagcatttccccgtaaggcaccggcatcgggttgccctgggcaatcatgttatccagtgaggaaaaatacgtgttctgtttaccgttatccgttgcccggtaatccggtgtctttgccttcggggcaagcatctgcgccacaccacccagaatcatgctggcacccagtgaaaacagcatcgtggtggcagaaaaaccaccggctgccagggctgaaccccataacgccattgatgccccggccgtgaagaaagaccccacaatggcagctgcccccagcacaatctgtagtccgccctttccggctccggccagtcgcggcacaatatggataaccgttccctcacccagtggttcgtgaaggcgggcatacaccgcctccggtgccgtatcctcaccggcaatgcgtatctggtaccagccttcgttcatctgacggcggaatcccggcacctgctgcgacagggcgcggatggcttccgccgccgtgttcacatacaggctgaagcggcggccaaatcgttgtaaatccccgtgaaggcagatgtgtgccagtggcggtgacgccagacagaatgcgttcgtcgttgccatttttcggaatacctctcccgtttactcagttgttcaggcagatggtgaagcagttcaccgttgccgcagtaaactttccagcacactggcggccgttactagggatccccgggtaccgagctcgaattcgtatacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcggtgcctcgagcggccgccagtgtgctgagaaggtcatatggcaatcagtaaaggaaataaatatgtcatcgaaaaaccggacccgcagaaccacaacccgcaatatccgtttccccaatcacataattgaacagatcaacatcgcccttgagcataaagggtccggtaacttttcagcgtgggttattgaagcctgcaggagaaggctggcaacagatgcaacgcatctgcgcccggccagcatgaaaaataacgagaaatgaacgttcggttacaggagcaggtacccactgtcctccaacaatatttcatcttcatatccgacggaacaagacttaccctgccgggatgtacagaataacaacagagtgataattaatttctgatgaaataatcagggtgcagaaggactaaagataaacgttttcttcacgcctttacacggcctgtccttctcaaatcgccattttgccatcgcctttacaacctgctcatcaaacaaatggtgcggctctgaacggataaactcaattcgggtgacagtaccatcagcaccaatatcaaacttcacatcaacccgtccctttatataatttgccgctgcataggccggatattgtggtaatgccttcaccaactgtcggggcatatctgttttatgttgcgtacagcccataaccagagaagacaacaaaataattaacggaagatttcttttcattttcattcccggcacagataagaataagtcttattctaacaatgccaccctgtcggtcatcaatcctctgcttgatggcaacgacaattatccgacttaaatcacaaatcagacacataacagggcttgcgaggtaacacatcgtccggtttcttccaccatcgcaccggacgagcgaccatgaggggacaacgccgcgcgccgttaacgcggtaaaccccggtgtgtatcgtttttgattatccccgcacactcgcgcagaggagtctcccggtcgggctgcggtcatggttaatgcgggaatacggcgacgatacagcgcatgatatgtcaggcttgaatacctttatccgttaaaaaggatatcagttaagttatcccgtgcagggtataagccattatcaagcccaccagtagatgggctttgtaatggctacttcgcttttgcttccgctcgcttacaccggcgcttttctttcttctcggcttttgccatgtccatgaatgcctgcatgatcgagttccgcatcatgtagctgacaaagtgatgattgacacagccgttgaggcgcaactgctcgccaaactcatccaccgaggccaatgcttccatcacgcccttctcgcctttcatgaacgctgagaagtcgcgccccgctctggaggcgcattcaatgacacgatcactcatcccggaagcccggggattgtgatctgcaactggttagccagggagttaatctcagcgatcaaaccaggtttcgtgtagcgccatgccgcaaggccttgcccgcagaagctcgccatatcttttttctgatcaaactcatgacacttcatattgagctgcgcacttaagctgttgcgatgctggagttctccggtgaagtagtcatccaggactttataggctgcatatttaaatccggggtttagccatgctgcataatcataagcaacaaacttcccgccatatgttccaccgtgtacaccgcgctcagtaaaaaccacagattcgtggtttttctccagctcggctaagaactctttggtctgcttgtttcgcaggtagtggtacggagattcagattcacttttaccactggctttccacatatcagtgaggcagatcatgccatcttcagcgacacggattggctgattgaagagggttaatgatttcatgtcgtatacctgttctttgaaatgaacctttgccgcataggaaaccagcccaccgaggctcgccagcactaactggtatcctcaaaggctcattccaaaggggcaggctcggtggttatcatgcgctgcggtgcgcggtgaaattcagatatgaaaaagcccacgcgtttacgtgggctggtgtgcatgacgtcaggactaaccgatgagttttaaatcagcttttcggtgttttttctgatcggtataaaaattttcatgtggaccgatgctaaggaggtagagctcaagtttatcgtcaagccagctgtaacccagaagcaccagttgattattcagctgaaatttatgcacacgaagaaaactgaggtctcctttcttttgcgttcccaacagaggattatcaattattctgtcgatctcatcttccacaactttcagttgcgcttccgggagtttactcagagacttttcaaaacgccgactctgataaacatcaatttcacgacctgtctgttcttctgacataacgcgttaccttgttgtgtctgatttcgctttgtgacagcagaacttcgctaataaaactgaatggcagatctggattatcttcagctatacgaccaatcttagcccagtgctcaatttgctttggtatgctgcgacttgcggcatcagcgtgaacctttacgtcactgacgaaatcatcgtctaaacggatgcttgttgccattatggggtgcctctctgtggttgtacttcatgcggtgcgtacgcatacgctatggaaaagcgcacctaaatcatgcaacaaattgtcgcataatgcaatctttacctccgcagaagattgacagcattcatgctggctctgttaattcaggcactgagtacggatatattcctgtgccccttccagttgcttctgcatcgtcatcagccgctctctgagggtgaaataatcccgttcagcggtgtctgccagtcgggggccggttgcattatccacgcgggcggtgccggtggcttcacgcacgggacctggacaggtggcgttgatacgcaggctgcggcgaccagcggcaacgtcagcgcgaagagtttcattttcagctctcgcatcagctaattccctcgagtattttgcatcgagcgcagcaacatcacgctggcgcacctgcatatcagtaatggttgcgtttgccagctccagctctctgacttttttatcgcgctgcgctttgtaggtgatggcgttatcgcggtaatgattcagccccagactaagcacaccacaggctaccagcaggacaataatcaccacacacagaacacggttcatatcaccaccaacggattgcccagaccagaacagcaatggccacaatacgaatggcaaatgccattgcccgaataagttcagcactcatctttttaaagttcacgatttcagcgcaatgaccagttttgccagcccatacagcatcggagacacagcaataccaacagccacccacttaatagcaaaagccagcgctctgctgatgtcatcagtcactgtcaccccagcagccccgacgaagacaacatcacccaggcgagggacagaaaaagagcaaccagcattagtgaaaatgaaataccgacaatcacacacaggacctttgccggcgttatgagtttgtctgacatctttaccccttgatagcagtaattaactgggcaaccacccataaaaacggaatcagccagaccagcaaaaatttccagtccatttttatcatcttcatgctgcggtagctctccatgcagcaagcagaccagcaatccactcaacaccttttggggtgaatttaacctgcgtaaaagcatgaccattgcccgtctcgcccgttttcacgctaaaccgccccgcatccaggtgatgcgagtaaggcgtcatttttccagcgaggcgatacattattccgttctccaacaaaaacagccggaaatcggtttctttgataccgagtaacttagcaacttcccggaatcccatcagaccagatgcttcaacatagttatcaacaaattcagccttcggcgctgctattgccagttgattttccagcactgctttctgttcagccagttttgccgcaaatcgcaacgcctcaggtaaagtccgggggatctgaataccatgcatcgctttgagtcttgccagcacagaacgacgaacggcctttgactccctcatgccaacgagcatcatctggtcaaaatccagatcatagtatgccgttcttgtctggttattgtttaaccggaatttttttccggttccatcaagctctagctcatcctcaatttttgcaagaaacttacgcggttcatgagggacttctccggcttctgcccgggctggattaataatgttattcagaaaatccagactactcatggatatttcatgatcgacagaaatcatctctttcatggttgattccttttagtgatgaaccctgcgcacaggaataaccagcccaaagagggttaaccagaccactgccggttatccaccagggctcatcctgaaaggttctttggtttatttacgcttgtgcgaagcgcagaaatgacaaaggcaccattacggtgcctctgcgtgaaataatgttcctgactttattcacttacattttgccagctcgcaggatttcgtgttatccgcccgcgtgagcaagcgtcatttttcagcaaaatattctgcttatctgtcgattccccagcacgccagcgcgctctcctggtctcgccgggatacctgaccgtaacagttatttgagcgaatacggcagtccctgccaccgtccttaatccaccagcgaatcgcctcacatgctcccctgcgatcaccagcattaattcgtttataaaacgtcgacgggaaacacttaccgggaccaatgttgtacggacagaatgacgcgatccccgctttctggggttcggtcagcggcactctgatgtttttctccacccacgccagcgctttatcacgctcaatggcgttaacccggtcgcattttcccttcgacagcttcatgccaggaataacaggcttaccatccacccgggtggctccacggcagatggtccagatccccgcaccatcacggtatgccatggtgtggttaccttctttttcgtcaagaaactggtcgaggatttcaggcgcagacgcccctgcaccaatcagcgccagaacggcagccgacaggccgtatctgatttttgcgttcatggatatttatcaggatttatcggttccgaatccctggatatgttaagtcttcagcccgccagtggtgggcactggcgtaaactcaacaatgcgagatggctgcctcgcaaagataatcaaagcaatggatgcactaagtaaaaataacgctgtgtcagattacctgatcgccgaaatggaacatctaattaaagaaataccaaagacagttgctcgtgatgataaaagattcctcaaggctgctgaagatgctctttcaacagtgaagcgcagcttagatgcgccgcgcgatcaagaatagtttctttcatttcatctgctgcaagcacctcattttttgttggggtgctttttttcaattcagcgatatagcactccagtttttcaatgcgtgattcaatatcatcgttttctgaccgcaatgccgtcggtggcgtcttcagagaaccagtaattattcccggtagttttcctctgtaggttatcaacacatcctgcgcctctaaaattatggggcgcttttccggcgactgctcatccccttcacataaagcggcagcaatatccatgaaaaactgcttcgcctgttttttcgcctcagcttcgtaaaactccagcgtggcaccttcagtacggtcaagactaatcgccacatatggcaacaacagtgacggatacccaccaatttccagtgccacagtagcagtaatcttatccgggtaattatttatccctttaacaaccagtttgtattgtttattcatcgccttactctccccgcgctgccttacgacggtcctctctgattttgaaatacaggttagtcagatatgtcagcagcccaaacagcagactccccagcacgcctattgccgcccactgagacggggaaaccctgtccagcaactgcaggaaccagtagcccgttcccaccgctgacgtggtgtatgacacacctgttgtgattttttccatctggtacataccccgtctcccgtactcggaagctcacaacaacaaaagggccaccagctctttactgatggccctgccccgccgttacagcattgtgcccggttcgggttgtgtgtctgtcatatccgtcaccggtggctccggctgaatatcaccattttccgtggtgacatcttccgcctgtggttccggaagcagttccggggatggttccggctgtgcaccaagcaattcatccagaatggcatccacttctgcatcaagacgcgcctcaaggttctgccgaagttgctgtttcagtgcgctccggacttcttcagagcgcaggacttccttcactgcctcagcagtgaccagcgattttatttctgacataggattttctcgttgaaaggggttattaagaaggttgttccggaatgagtggggcttctgtttttgctccggctgactgactggcgctgattttctctgcggcccttttatcaatctgcctgcgccagaaatcgcgcactgccctgtacccacccgaaagaagatacagcacgcataccaccgtacagaagtacagcatcacctgatgaacaaatgtcatagtttcttaccgttatggttgacaatgagaactgttttcatttaaaaaaccgatatacgaaagcatcttttctttacattctccattgggattacctccgccagcttccgttcctgccgctggcggttttttttgccggttatgatgatgcccggctttcgttaactttgactgtgaccgtatcaagcagtaccggatacgtcgcttttgcccccgtgatatctgtcagcgtcagcgtatctgctgtaaagccatcatttgtccacatcaccaggtcaaacgcagactgctctgcatcatcaatcaccggcaccactttttcgctgttatttcccgcaaagcggaaaacaactgtatgccagttatggtcaaatgccccaaatgtgcccagttgcgcattcgactcccccttgtggtacatcagattcagatttgatgcatccgtctgaaggaagaaggacgccagcatgctgtttgctgtcgcgcctgacgcccactgcgacaccggccagtacagaccaaagacaaactgaccgttaaccagttcgacaccctccgggatcttaaaccgcacggcaatttcacctcccttactgagaagattttttgcctcctccaccgcaacagtacggaacatcttccaggaggtcagtttacccggctgtttttccagtcgcagcgccttcctgccactgtcatccgtcacagtgcctttaccaccggacgcattccactgctgctctgtccatacaccactgccactgttcgcatcatatccggccaccattcttgttacggcttcagtatgaccgcctgcagaagtacctgcaccctgctgttgcgtcggacccgcagagccagactgtgcatcccccgtggaggctggcgtggtcgccagcggtgcagactgcccgctcaggaacggcagcaaacgcccggctcgcaccagtatctctcctgccagccgatctgaaacaatgcctcttcgcgcccaggagctgaagtgcgttttacgatcggctgtcgtccagttaccattactgcgtgacgcggcaccatagtatcccgccgtgataatgtccggatcttctgacggctcgtttgtcggcacattcgcaccatgctcatccgtcatcaacggcacaaagtgaatattctgcgccgccttgcctttatagcctccgtaaaccgcctcatactgcactgcatacttcgccttccagtcgtacgtggtgtcaccgcaaatccacgggacgccggacgttgtcccgccaatacactggtctgcaatatctgccaggtctgcacggtatttatttaccatggcaagaaaaagtgcattgtgctctgcatgtctccccgaactgacatctttttccccctgcatccagatcaccgacaacagcacgtttttcggatttttcttcagggctgcacgcgttctgctgaccaggtcacgatacaacggtttatccaccccccacagggaagagcccgctgtcgcacccgacgcctcattaaacgcgccctctgctcccgcagtaaatcccgaatcgccacgtccacacgggacaagaaggatccccgcacgggcaggcataaacggcagcagttttttggccacatgcagggcatgccccacacagccatactgccctttattgaggtctgctttcgggtgattcagattactcacgtcctgcacatcatgcagacaatggtctgcaggaataatgtcgttatatgcacaggccgcaccgcccggtgtcaccgtgctgcgacgcgccagttgcttaatacgcgggtcaggacgatcatacgtatccggcagcggcagcccctcgccaaaagacatcgagttggactgcccggccagcgcaatgacaaagtaatattccggttcgctggtggtgctgataacagcgccaccatcacccgacggttgcaccaccaccggtgtggtgacatcaccttccgccgcaatggcctgcatcagggtatagggcgtgatggccaccggactgccaaatggctgccacccctccttcagtttttgagtcagtcgctccgcaaggtctgacggcgatgccgccctgacaacatcatagtgtttaaatgccatggttctttccaccatctgaaaaataattctttaaaatacctgacatgtaatacagaaaaaacacaaaaccataccttaaataaaaacctcatcatcaagcagatatgcatgggtaaactacaagacgagatataaaccaccctgcatttaaataaacaataaacaacatcagaaaaataattctgctctatggtttacattcaaaaatatcatttatacttttcagaacatcaccagcaagacataaacaaggaaactaaatgaagtggattgtgattgatacagttatccagccatcatgcggaatatctttttcagtcatatggagtaaaataaaattaataatctggtatcaatcggatgctttcttacctcctgaaagtatatttacactgactcacacaggtatcatgctcaataacaaagtgctacctgtaaccatttacaacgtagtaccattcaataaaaaattctggaatttaatcaaaaacagccaggaatgccctacaaatacagataacgtattgaatgaatgctttaataaccgttgcactctgcaaatatgtccttatggactaaaacaacaaagtccataaggagtttactcacatctgacaaaatcaatataaacagcccctccggagaggggctggagagtggcgctatgtgccattgcatggtgccgggtgcctcccggtgagttcagtatcagcacctgaacccgcacagaaaggataagggtcggtgacaaaacaccagttgctgattgcccctccgcacagggggattcaccatgccagtttcttttaacaaactccccgcaaaccagacaacagtcaaccgcctgaattgtgaggcatttaaaaatttcaacgggtaactgataccctgctaatcgcctgatgctttctttttcagcaacgggaaagcaacaaccaccacacccgccaccagcacaccgtcagccagcactgacattatccggctgctgaagtccaccatcaccaccagaaacagcaggagcgcaaccacagccagacgcatttttaccgtcacagatgattctccagacgaaggcccaggacaccggcaatctcttccagcaccttgcgctcttccggctctatttcgccgtctgcttcggcaatggccaccgccacatccagcacgtcttccgcttcacgcgtatcgtgtttcacatcctcgatctcacgtaacgccgctcgacgaccaattttaaagttcgtatccagctgaccgataatggttgcgctaatcgcattaatttctgacgtaaacgcggacaacgcaggctggttacgcaagacctgctcgatcttcgctttctctgaagcctcacattcaccatctgcataggccaccagataggcagcattaataaccgcctgtgccagatcacgtttctcaaactttttaatttccactgccgctcggcgggcttttttaccaaaaataccaaacatcgtgacgttcctttgggtgggtgagccaacgcccgggagcgatctgcccacagagaaagtcacactgaccactccgtaagctcacccccgaaaggctctgtggttgatatgcgccgggcgtggcgcagatacaaaaaaagcccgccgaagcgagcctgataataaatctggagcgggtagcgggaatcgaaccacgataagaaggttaacagccttccgtaatgacctttatacgactgacccaaataaaaaaagccaccgttgcaacttaagagtcactaacggcagcttaccctctaattatggctaaatggctaattgcatgtcaaggcttttaacagcaacatgcttaactttctcaacacgtttacgcattttgaaagcattttgcattggttggtacaaaacaaataatgacgctttcaggatatcgtcaatttcgtttctacaggttgccagtgaaggttttctccatccctcgccaccgcgtccacacatcttgcgtggctttgcagtcgcgtgatagtaggatgcaattgctctcttagatgaaccatgagcgtagtagctgaggaggatgccaaaggctttcttgtcaatgtacatgacggaatcgacgacctgagaaatcaacattccatcatcatcattacacattggtcttgtcataactcttcccggctctacgctctccatgaacttcgctattacgctgctcatgcgcttttccagacgacctgaataaccccatgcgccccacagttcaagccagccattcagccaatcgtgctgttctttggtgaggtttagttctcttatgcccatgcgacttctcccttgttatctggaatggtttttactgagagcgtcatgcggcctcacttctgctgtttcgcaggtctttgagtttctgttggtactctgccttgatggccctgcactcttcgacagtccagcgatggcggttatggtttgattcgatttcatctactgcttcctgcccgatgcggctaatcagttcgacgcgatacggaacgagatttccgcttttgtgctggttgcacaccacgcattgcttgtgaatattgcgttcatcaaatcggagttgaggtgccgcagcagttgtccggtaatgtccggcatcccactgagcagacgtgagcgttccgcacgagatacatggtaagtcgcggtctctttctctgatgaaggcgtttacggcttgttgggcttgtttaatccagtaactgcggggctttaaggcgagttttcgaatcttcagtttatctttctgtttctgctcctctcgtcgtcgtttcttctctgctgctttttccgctttttcgcgttctttacttcgtcgttcgagtgctaattgagttccgtgttccgggcagcaccaccactgatttgagaatgccgggtgaaaccattctttgcatattttgcatttccttcgcgctggtttagccattaagcagcctcccctgttactttcagcattccgttatcgagcagctttctggtcagccactgttgaccacgcccggtgatttttgtggtgaacgatatctgtattccgtgatttgtgttgaccgctgtttctttcactgtgaaatagccgcgctccatatattcctgcattggcacattgcgccgggcacctgaagcaataaggattttgtgatcgcgcatccacgcaaacagtttgtttggaccaattccaacaacctttgcatagtttccaatcaaaattccgctggcctcgccaactcgatcggcaaactcaactttaggtgcggcaattgcgagctggttttccagttgcattttctgctcagcaagatcagcagcaaggcgcaacgcttctggtagcgttttggggatattaaccgcagtttcttcaagctctcgccaacggtcaacaagacgagcggtgaattccggcgacaattgggcgacgacaataatgctgtctcgcttaccttgttcgccttcgaagacgtaagcctcgacactacggcgcagtcctaagttattgattttttcgaaaacctgcaatgcaggaagttgaataactccagatttagccaggcgctctattgatatttttacgttatctggacgactccccaccaactcagcgatttcaatgctggtcattttgatgatgctgctatttatcagctcattcattgtcatgtcctctcatattgaaaattcagcaataaaaaacccagccgaagctgggtttgttaagttgtcaattgtcagtagcgatgcagtgaaggcggcaactctttgttcttaagcctttcccatgccagaaggttcgtcggcccgtcaggctcataaatatctatatcccgcgtgtgattaattaaaacgcccctcgccctcccgatggtatacgagaactcatagccgtagtcgtggcatatgccggaatagccagactgaatcagttttaatgcgggatacaactcacggaacaatgcctgtgagcggttggcataatcccatagccatacaaggctgtttgcttcttttgcggaaagtccgttgagcttcttctcttgtttgccagtatttttctcgcactggctgaaatagcagtcttccagtttttcgaacacttcccacgcctgatcagtttcgagcatttttgcgtgacgggctgcgcctcgttctgtccagaggatgagggagcgaacattgcgggcgattttcacagagtaactttctgttacctcgcggctaacagactcgcttaaagatagtctgtgcttgaactcacgtagttcattcccttccaacttaaagaaatgttttccctgtacaaatcgcgcagagttacgggaaaaattcatttttatattgactgtttcagtgccatacaattgcgccaataattctgtagtaattacggggatctggttgtaggcaattggggaaagagtttcaacggaaatttgagtcgccatgacaacgccctctggttgatgaatttaactatcaccaccgtcaggtgcaaatctttgggtggtgagacgtacagggtttgcactaccggatcaaccaaccggcgagcctttcggctcccccatacgccccaccataattcagatgtgcgtgtgcttacgacaacaaaaaacacgctcgcggcgtgtgtctgtcgcggttgaatatccggggtgcaaatcccgacgccagattttgctggcgcgtgaggaatatagccccgaataaatcatcacgtcaatcaccttgttttcctcgcacgatgtcttagccaccggatatcccacaggtgagccgtgtaattgaaggttttaacgtcagattcttttgggattggcctgggtttatttctggagcgtttcgttggaaggtatttgcagttttcgcagatgatgtcggtgatacttcgtcgctgtcgcctcatgccgccctcctgacgccctgcccgatcgccatcaatgccgctttggatacggtagtaaacatccgtcgaggactgatgaacggtcgccaaatcagcagcatggaacctttgctgtttcccttcttctccagccctgtcgatggttcgataaaattaatccgtccatcagtgatgatgcgaacttcgtcaacactctccagagccttactgaaccatccgacagacatatcctctggcacaagcatcactaccgtctgtcgttgttgtatgcactgctcagcggctttttccacccacggcctgatattgctgtacggtgggttattccagattgcaccgtggcttacccactcagaattgagcgcgtcgtcggcctcagttagccagtgagcacacagagcatttttgtcgctcgctgccgaatccagccagaatccaaactcaatatccagtgcatcaaaaagccaaagcggcgtttgccagcagtccttgtcgtgtgctggcgtatttgatttgatagtcatgcagccttcccttttcgttgtgaccattcatactctcgccaggagtcatcactccaccgcacgttgcgctctgagccgaaccagaacatgatttcgataagctcagtcatgttggcctttcgcattttgctggtacgcacaccaagcatgacaacgccaccgtcgataccaggcacacttcgttgctccagttttttggtcttaagccacagggcagtgaacaggtctttccagtcttccggcgccagccgttgaccatgccatagcacctgacgcgaaacatcgttcagcatcggccacatacggtcattctgcgctttgctgcgcttgggttctttaacgtggacttcgtggggtgacttgtcgtcgatgggtagtgagagaatggcgtctatggcgttatttctgattgcttcgttgcgaagcagaaaggtttgcttcatctcctgctctccggttccatttttcagccgccgcagcaactgatggtgcccatgcccccctggcttcacagaggtcacattctgcatagccccacacatcaatatttattccggcctcaacccacagacgagcattaccgccgcaaaacggacattcttttagctttggctgggttaatgataggtcgctcatgctcactccttcactttaaatccagactccggataattctgttgcgctgaaactcattgttgagtttgaacaaccgtcgaagaacacggtcacgcggatagcgtcgtgcggcaggtgaatgctcatacaactcatcaagcggcaaactggacgatgaacgataccgataccaacgcaccaactcttcacgaaaattagccctgacaagctcagctatcgtactcatttcttaaagcctccaattactcttccccaaataaaaaggcctgcgattaccagcaggcctgttacaagctcagtgatgtagatggtcatcttttaactccatataccgccaatacccgtttcatcactgcactctggcgacactccttaaaaatcaggttcgtgctcacctttccttcccgttcttccctggtagcaaaccggtaatacaccgttcgccagaccttaccatcaatgacaaggattcctgcccgcgccattttagccgcagcctgatttatactggttacggttgcgcctgttaccgcggaaacgtcctgtgcacagaagttcttatgcgccccgaggtaatgaataattgcctctttgcccgtcatatacttgctcctttcagtccgaacttagctttaatttctgcgatcttcgccagagcctgtgctcgatttagaggtctgccgcccatgacaggaagttgttttactggttcaggtatcgtctcaccacggttaattctcgcagtcatatggacaagctcatctgcggccttacggcgtaattccgcatcagtaagcgcattggcccgcatgttctgatacaggttggtaaccagccagtagtgcgcgtttgatttccacggataagactctgcatccggatacaggcctcgcttccggcaatactcgtaaaccatatcaactagctcgctgacgtttggcagtccggcgataacggatgcttcttcccggcaccatgcaacaaactgcccgggtgatggaagaaatggtcgattctgccgacgggctacgcgcattcctgcgttaacctgttccatcgaggtgatcccgttttcccggaaagccagaacccactggcggcggatttcattcagttcgttctggtcccggttagccagactcgccgggaaagttgccagtaactggctgaacacaccgttgatgatctgcgctacctgttgtacctgcggcttttcgtcgtactgttccggcatgttgttggcgatccgacgcatctgctcacggtcaaagttaaccatctgtgcggcgatgtttttcataaatccaccccgtaaatccagtcagtgtttgtcaggtcgagttttggtttgctggctgtcacgcctgcctgttgcttgttacggttgatttcgagctgggtccacttgtcgcggagtttggccggacttagcacgttaccggaccagaagttgtcctggcatgcccagcggaacagcacgcacatgtcgcggtggttacgtccgtcacgttcacgcatcaggcggatatcgttagcccaccctgcaaaattcggttttctggctgatggtgcgatggtcttcaccatgtcaaacatccactctgcggcggtcaggtcttctgctgttccccacttgctgccgctctgaattgcagcatccggtttaaccacagaaagatcgttttctggctggtcagaggattcgccagaattctcggacgaataatcttttcttttttcttttgtaatagtgtcttttgtgtccccctgttttgagggatagcaatcccctaatttgagggatgttttatccctcgttttagggggggttccctcgttttgagggatgtccctcattttaggggaacctccctcgttttgagggatgcaccattctgagatgtttttatttggtccaaacatgccgccttgctgcttgataatattcattctgacgagttctaacttggcttcattgcaccgtttgacaggtaactttgtaatctcgctaagttgagaatcggtgattctgtccattggtttattccacccataggttttacgcagaatggcaagcagcactttaaactgtcgcttggtcagatctgcgcctgaataagcctcaatcagcatatttgatagtctggcgtaaccatcatcgagatctgccacattacgctcctgtccggcaaagttacttctgccgaagttgagtatttttgctgtatttgtcataatgactcctgttgatagatccagtaatgacctcagaattccatctggatttgttcagaacgctcggtcttgcacaccgggcgttttttattggtgagttcatcaagcgcatacttaaaagccctgctaatcggactgatgtctgatgccattccgaaagcacacaagaccgaagcaataaatctccagtccgttctgcttatcttcgattcatgacagccaatcatctttgccagaccgcgctgggtaagcgttgacaggttgataagtaaatctgtttctgcgcgatcaacgtcgcgctgtgatagtttgctgtaacttgtttgttccatttcttaagatttccaatagtgaatagttagttgaaaggtatgcgtggaaacgcatatggccttagttggtcagatatcttgggactcgcttttcagcgacgtaggacgaatgtccgttgttacaaagagcgggtactgcttaggcggctttgttactggatggagggaaaacatcatccaaagaacattggcaccctaacttcctgaggccttctacgatctttcggcaatcgttaagtctaggagtacggatattcagctcatagttggcgatgcgggattgcccccaaccaattgccgaagccagtacagcttgcgaaactccgattttttttcgctgctgggcaattttgttcattgcggtctccctagtattaatcacacacccattacacacaatttgtgattaacagtcaacctcaattcgtgtacagagttcaatcacgttgcgtgttacatttaaaggatgaaaacgatgcatgaaattatcggggaaaggatcaagtcccttagagaagctaaaggacttagccaggctcaattggccaagctttgcggctgggctgcgccttcacgcctggggaactacgagttaggaacaagaaaggttagcgcggatgacgcgctggttcttggggcggcactcggcgtatctccggcaaaaataatgtttggcgaggattcagacgctgtatttcgccaatatgagtacccgttattttcttcagtgcaggccgggccgttttcggaggttggaagctacacagcaagcgatgcaaaggcatgggtcccaacgaccacaaaagccagcgaaaaagctttctggcttgaggtgaaaggccattctatgactgcgccacagggcgtaaggccgagttttcctgagggtatgctgatactcgttgatccggccgagccggtagagtctggggatttctgcgtggcttctgcaaatggtgattcagaggcaacgttcaagaagtatgagaaggatgcaggggttagttacttggttccattgaatccggcatacagaaccctggactgcgatcacacatgccgcatcataggcaaggtagttaaggctcagtggcctgaagagacgtttggatgatggatggtcgcagagatgctcgtagagcatacagcgatgcaggagaatttatggcacttaatttagaaagaatatcttttataaccccatttgatagcagcgaagaacccaaccaaccgacgcttaattttacatgcaatgaatttcctgcgcggctatcgattgatttcagggttggtatgatcgggttgaaaccaaattcaagatataatttgggtattatggtaatccccgcgcacctaattataaaaaaaggtgaggaaattcaattccctgacggctcttcggaatcagtttcacttttcatcgatacgaaagatagccattttgaaacaggggttggcggacaggtaatagtaacattgaaagaaattagggtcccagctaaagggctgtatagtgttatagggatattgcaagataatgaagaccctaaaaatgaacttcataaaaatgaatcatttttcaccgtagagctattatgagtgacgacagtaatttaaataatcatggaaagcaagacaccaacatatctgaaagccggaggttgaaggttgttggcggttccgattttgaggctgaatttgataattctcccaccaaggtgcaaaataattacataaaaccgccacaaacggaggaagaagtgggaacgatcagcagagaggaacttgatgctcgcttagctgctaataaagcagagatggagtctattgcttcttccattaggactgacatggctctatctcgtgaaagcgttaatgtccaatttgcatcacttaatgcagccataagctctctatcgtccaagatcgatggaaagatggatagcgctgctggcgatataaaagcaattaatgggagattcgaaggaattcaaggacaaataacaggggttaataccgcaattagtggtgttcagtcgggtatttctatacgattagccatttttagtgtcattatcgctgtaatagttgcgattcccgggctggtatcagctttaaagtcagaccacgcacctttgcaacagccttccactttgcaagcgccgccacaaaatacccagccaacagacaacaaaaaaatcactccccagcattaacgcattaacccggcctcagcgccgggttttttgttgcctgcacataactatcaggacagcacctgccagccagcccaagcctctgattaaattactataattcttaatacaactcccatatcccgccatctcgtcaccacctacttcgctcgtttttcgaacttttcagcacaccatcctgctgtttcccccgccttaagtaagcaaacccatcgcggggaaaactatttacacaaaaaaatcatacacataacgtgtcacacccttattttacacattttgtgattgaccattaaatcacaatatgtgactattatttccatcagcaggacgctggtagccaaacggaaaagattggcaggctctttaaacaacgtcgaacactcgactacgtggctgaaaagccagatcacccaaccacataagctgtgggatgcaatgccgaagcaaccgtctcaggaggagcttcgagattgcatcgccaaagtttattcgggaggaatctatgtccagaaaaacagaatttaaaggcaccgcagcttctcgccgtagagctcgtcgcgcaaacctgcaaagtcaggagtcgattagctccgacaagctacacaggccaaccccttcacgagtggtcttgcaatgcaagcgcaaaccagcaatgagagcagaagttataactctgacaacgttgaccagaaaatatgaaggttcaacttgtcttccaaacgtagccatttacgctgcaggctaccgtaaatccaaacaactgacagcaagatgacttgtgttggtcgccagaaaatgaaattaggcagcaaaccacttatttgagaggaattaatatgtcatcaatccgcttaactacgagaatgaaagaggaaatcgctcgtaacgctttaattaagtccggggtgttcactgaacttgaagaagtaacaaagttaaagaaccagcttgcacttgacgccagagttattgcgtttggcgggaaaaagaaaaccgaagaagtggaccagctggcatcaaagttaatggctgcaagtgaggaacttcaaaagctgggatgttcattttactcatgcgatgtcagttcatgttcgatttatctgactgtatctggaagaagggttggctggcattcatacggaaaagacggcaacggtgaagatatattgctccctacccccgacaaagataagtgcatgtttgacgcagaacacaaaataacaaaaaggtttgatgaaatctgcgcattgcaacaaaaacttgaagccaggaaaaaggatatagaatcaaacgtatgggctgctttgaactcagtcacaacagttaagcgacttattgaagtttggcctgaaagcaaagagttgctaccaaaagaagcagataaagcaagtgcagcacttcctgctttacgggtagaagatttgaataagatgattggacttccttccgaggccgcataatcggcctttatttttggcataaacaacagaataaacactgcactgtgtattcattccaacgagtgaatacacggagcaatgtcgctcgtaactaaacaggagccgacttgttctgattattggaaatcttctttgccctccaatgtgagggcttttttatatgcataccaataacgcttcactagaggcgttttcgttatgtgtaaataaataaggagcacaccatgcaatatgccattgcagggtggcctgttgctggctgcccttccgaatctttacttgaacgaatcacccgtaaattacgtgacggatggaaacgccttatcgacatacttaatcagccaggagttcccaaaaatggataaaacacttatggctatccagactaaattcactatcgccacttttattggtgatgaaaagatgtttcgtgaagccgtcgacgcttataaaaaatggatattaatactgaaactgagatcaagcaaaagcattcactaacccctttcctgttttcctaatcagcccggcatttcgcgggcgatattttcacagctatttcaggagttcagccatgaacgcttattacattcaggatcgtcttgaggctcagagctgggcgcgtcactaccagcagatcgcccgtgaagagaaagaggcagaactggcagacgacatggaaaaaggcctgccccagcacctgtttgaatcgctatgcatcgatcatttgcaacgccacggggccagcaaaaaagccattatccgtgcgtttgatgacgatgttgagtttcaggagcgcatggcagaacacatccggtacatggttgaaaccattgctcaccatcaggttgatattgattcagaggtataaaacggatgagtacagcactcgcaacgctggcagggaagctggctgaacgtgtcggcatggattctgtcgacccacaggaactgatcaccactcttcgccagacggcatttaaaggcgatgccagcgatgcgcagttcatcgcattgttgatcgtcgccaaccagtacggccttaatccgtggacgaaagaaatttacgccttccctgataagcagaacggcatcgttccggtggtgggcgttgatggctggtcccgcatcatcaatgaaaaccagcagtttgatggcatggactttgagcaggacaatgaatcctgtacatgccggatttaccgcaaggaccgtaatcatccgatctgcgttaccgaatggatggatgaatgccgccgcgaaccattcaaaacccgcgaaggcagagaaatcaccggaccgtggcagtcgcatcccaaacggatgttacggcataaagccatgattcagtgtgcccgtctggccttcggatttgctggtatctatgacaaggatgaagccgagcgcattgtcgaaaatactgcatacactgcagaacgtcagccagaacgcgacatcactccggttaacgatgaaaccatgcaggagattaacactctgctgatcgccctggataaaacatgggatgacgacttattgccgctctgttcccagatatttcgccgcgacattcgcgcatcgtcagaactgacacaggccgaagcagtgaaagctcttggattcctgaaacagaaagccactgagcagaaggtggcagcatgacaccggacattatcctgcagcgtaccgggatcgacgtgagagctgtcgaacagggggatgatgcatggcacaaattacggctcggcgtcatcaccgcttcagaagttcacaacgtgatagcaaagccccgctcaggaaagaagtggcctgacatgaaaatgtcctacttccacaccctgctggctgaggtttgcaccggtgtggctccggaagttaatgctaaggcgctggcctggggaaaacagtacgagaacgacgccagaaccctgtttgaattcacttccggcgtgaatgttactgaatccccgatcatctatcgcgacgaaagtatgcgcacagcctgctctcccgatggtttatgcagtgacggcaatggccttgagctgaaatgcccgtttacctccagggatttcatgaagttccggctcggtggtttcgaggccataaagtcggcttacatggcccaggtgcagtacagcatgtgggtgacgcgaaaagatgcctggtactttgccaactatgacccgcgtatgaagcgtgaaggcctgcattatgtcgtgattgagcggaatgaaaagtacatggcgaattttgacgagatggtgccggagttcatcgaaaaaatggacgaggcactggctgaaattggttttgtatatggggagcaatggcaatgaagcatcctcacgataatatccgggtaggcgcgatcactttcgtctactccgttacaaagcgaggctgggtatttcccggcctttctgttatccgaaatccgctgaaagcacagcggctggctgaggagataaataataaacgggagagtgtatgattcattttcacggtggtccaataactcccgatacctgtgcgttgaaagcctggaaaggcagacacgcattcatcagttttgctaatccagctcagattgatctggcttccgaagtcacccaatcatttgctcttgataatggtgcattcacattctggacaaaaaacaaggccatagactggaatgaatattacagatttgttgaacgctggggtaatcaccctcgtttctcattcgcggttatcccggatgttatcggcggaaccagtgaagagaatgacgccctgattgcggcatggcctcacggtaaatttattggtgctccggtgtggcacatgaacgaaccagatgagcgatttattcgtctgtgccatgagtttccccgcgtctgcatcggctcgatgggggaatacgatgcaaaacgaccgagagcgtgtcgggctaaactacgcgatcttatacgtcatgttgtagatcagtacgactacccaatcaccaagattcatgggttacggatgttaaataaagacatttttactcatgtaccgctttcgtctgcagacagcacgaacgtcgcaagaaatataggcatcgacaaatcctgggtaggttcgccatatgctcccgcaagtaaagaaacccgtacgcaagttcttgtggaacgcattgaatcattcaacagtgccagttcacttaattacaacgctgaacgggacgtctttacccctcaactggcattcgaagtgtgaggccaatatgacaatagaacataataacgcccttcgcagcattgcccgtcaggctaattctgaaatcaaaaaagccagacagcagtttccggataaaaacgtcgatgacatttgccgtagcgtactgaagaagcaccgcgaaacggtaacgctgatgggattcacaccgactcacttaagtctggcaatcggtatgttaaacggcgtctttaaggaacggtgaacatgaaaagcaaaatcatcagggagctacaggctccttttttattattcgcattcaccctcaagcgtattaaccaacaattcagggattaatggaagatggcagacctcattgattcagcatcagaaattgaagaattacagcgcaacacagcaataaaaatgcgccgcctgaaccaccaggctatatctgccactcattgttgtgagtgtggcgatcccatagatgagcgaagacgcctggccgttcagggttgtcggacttgtgcaagttgccaggaggatctggagcttatcagtaaacagagaggttcgaagtgagcgaaattaactatcaggaactgcgtgaaaaggcagagaaagcaactaaaggaagctacatcgtagggcatacatctgttaaccagcacggcaatttaacaggagtttttgtttgtcaaaaatggaaaggagaacccggtggcgtgattgccgaatgtcatgttaactgcctgattgaatcagatgctcaggcttatgcaaacgctgaatttatagcagatgctaacccagctaccgtactggcgctactggatgaacgggaaagaaaccagcaatacatcaaacgccgcgaccaggagaacgaggatattgcgcttacggttgggaagctgagagttgagcttgaggagacaaaatcaaaactcaacgagcagcgtgagtattacgaaggtgttatctcggatggaagtaagcgcatagcagaactggaagcgcgggaaataaaaccagccaaaggtgaagttctggtcgttgtatctggttttactggttgcggaaaaagcaccattgccggggaaatagaaatcgcgatgaaggctattggtgtaccggttaagtggactaatggcgatgcagaaaagcgcatgactggcgctgactggctgacagcgattgagatgtacaaaccaaatgtgcgcatcgtggaagttaatgtgccacgcgtcgctggcactcgcatcaaaggagagtgagatgaacggacaaatatcaattgttcgaccgggagcatgtgacgatcgcgagatacgaatgattattcgtctggcaatggggaaaacaataactgctctcattactcctgaaaatctcgcattagcattaacaggaaagtcagacctgccagtagagataaagctgcgaaatattgagattaaagtgaaatagttatgaatactcttaccaaagaatggttacagaacacgattaccagcattgagtcagcacgggatgaaataccgttcggactcgatgaagatcaaaacaacatgcttaccgcattaaaaattgtactggcatcgctggaacgcgaacagattcgccacgagcatgccaaatggtctgactccacatttggctgcgttggcccccattggtccactgaaacacctctcaaaagaggctctggaagccgcagccgaaccagacgatctcagcgagtgggctgatatgcatttcctgttgtgggatgcacagcgccgttctggcatcagcgatgctgaaattaccgctgctatggaagataaattgaagatcaacatggagcgccagtggcctgaaccaaaagatggtgagcctcgcttgcacattaaagaacccggcaactatccggtaattccggatggtttatccacggtatgagctgaggcttatcaggttgtaggagttatggcagatgcgcttggtgtattcggtgatgcagcagtacagaaagttctggataacctgtcacagcaaaaacttgttcacagagatgtgctgccgttctcgcttccggtaactccggatggttggataagctgtagtgagcgaatgccgaacgataaacagtatgtttggtgttggggtaagtcttacggctggactgagtgcgataccttcgaagggtattacgattgttcgagaaacaaatggtgggcagttactgacaatggggaagaaccggcatcgaaagtaacccactggatgccgctgccagaaccgccgcaggaggtgaatcaatgagctggcctgatgcaatcgtaactctggggatggtattcgcagtagcgtttgttgtgtactcgatttgtcgatggggataaccacatgttcgctttgattcaacgcgggcagatatacaccgatagtgctggctacccgataaaaattgttcgctgcataaacaacactgtgttgtacagaagaatggatgggcgaacacagtcagtaaaaataaacgatttcaatgaactgtttgaacggattgatcaccaagaataccgacaaattctggcagaaacagagcaggaagctcatctgaaaaaattacgggccatgaaaaggaagtaaacaatgaataaagcatttgaacgatgggtccaccagcgttacagcaatcgctatgatctgacgcgagatgttgacggtttctactgtcgtgaagttgtgaagcgaatgtttgacgtgtggtgccactgccgtggatgaaaattttatgaggttggcatgcagacaatcatctatcagataacccccagcaaatggtgtacggagagagtcctcattgcatcaacagggctaaagcctggcaccattgagcgggcaagaagaaagtcatggatgcagggaaaagaataccgccattacgctgtagaaggtgatccggggcactacagtgaatgcctgtacaacatcgaagaaattatgcgatggatcgaaaaccagaaacaaccaggtgccaaaaatgcaagttccggttaacctgttaatgctcctggacgtctgggaggtttaatgagtaacgcatcatacccgacaggcgttgaaaaccatggaggatcactccgtatatggtttcactataatggcaaacgtgtcagagaaaacctcggtgttcctgacacagccaaaaaccggaagatcgctggtgaacttcgcacttccgtttgttttgcaatcagaatggggagtttcgactacgccgcgcagttccctaattcccctaacctgaaacactttggtctgggaaaaagagagataaccgttaaggcactttcggaaaaatggttggaccttaagaaaattgagatttgtgcgaatgcacttaaccgttaccagtcagtaattaaaaacatgttaccaatattaggtgaaaaaaaactggtttcatccataacaaaagaggatttacttttcgtaaggagagatttgttgaccggttaccaaaagctttctaatggaaagacttcttccataaaagggcgctcagtggtcacggtaaactactatatgacaaccatagctggaatgtttcaatttgcaacagataatggttatacctcaggaaacccatttaacggtctggctcccttaaaaaagtccaaggtaaaaccagatcctctcacccgtgacgaatttattcgttttattgaggcttgccgtcatcaacaaacaaaaaacctgtggattctcgctgtatacacgggtattcgtcacggggagttggtatcgctggcatgggaagatatagaccttaaagcaaggactataaccatccgtagaaattatacaaaacttggcgaattcactccaccaaaaaccgatgcaggcaccggaaggacaattcatctggttcaaccagctattgatgctcttaaaagccaggcggaaatgaccatgcttggaaagcaacattctgtagaggtgaagcagagggaatatgggagaactgctgtgcataaatgcacttttgtttttagtcctcaggtaacaaaacagcagcagttgtccggacctcactacaaggttgactccatcagggagtcatggacaagtatcttaaaacgcgcaggtctgagacacagaaaatcgtaccaatccaggcatacttatgcatgctggtcacttgccgcaggagctaatcctagttttatcgcaagccagatgggccacacaaacgcacaaatggtattcaatgtttacggagcatggatgaaagacaacaatcacgaacagatagaactccttaacaaaagactatctgaaagtgtcccatgtatgccccataagaaagctgggtaaaataaaaacttgcaaaatcaattagtttacccttaatccctgtcacgttacgcgcgtggcagaggcgttacggattgctgaaaccgcaacggacagacggcggtcatcggctgttcaacgatgccgatattgaccggatccgcgagatcaaacgctggatcgacaacggcgtgcaggtcagcaaagtaaaaatgctgctcagtaatgaaaatgttgatgtgcagaacggctggcgcgatcagcaagaaacattactgacttacctgcaaagcggcaatctgcatagcctgcgaacgtggatcaaagagcgcggtcaggattaccccgcccagacactcaccacacatctgtttattcctctgcgccgacggcttcagtgccaacaaccgactctcctggcgctgctggcgatcctcgacggcgtactgatcaactacatctctatttgcctggcttcggcgcgcaaaaaacagggtaaagatgcactggtggttggctggaatattcaggataccactcgtctgtggctggagggctggattgccagtcaacaaggatggcgcattgatgtcctcgcccactcgctcaatcaactacgccctgaactgttcgaaggccgtacattgctggtatggtgcggtgataatcgaacctccgcccaacagcagcaactcaccagttggcaggaacaaggccatgatattttcccactcggcatttaatgattcgttaacaaatgcgctttactgtacaatcctttcgttaacataaggagtgcattatgcgcatagctaaaattggggtcatcgccctgttcctgtttatggcgttaggcggaattggtggcgtcatgctcgcaggttatacctttattttgcgtgctggctgaacgcctgcaccagcctttcaaacaggcggtctgcgatgatcgccgccagtgccaccagtaacgccccctggatcacatacgcggtattaaatccgctaagcccgatgatgatcggcgtacccagcgtgctggcccctaccgttgaggcgatcgtcgccgtaccaatgttgataatcaccgaagttcgcacgcccgccagaatcaccggagccgccagcggtagctcgaccttatgcagtcgctgaccacgactcattcccatacctttcgcaacttctgtcacgctggcatcaatcgctcccagcccggcaagtgtcgcctgcaggacgggcagcacgccgtaaaggatcaaggcgataatcgctggtttcagaccaaagccgatcaccggaacggcaatcgccagcactgcaacgggcggaaaagtctgtccaacggcggcaatagtttccaccagtgggcgaaattccgcaccccacgggcgagtgacagcaattccggcaccagtaccaatgatcaccgcaaacaaactcgaaattcccaccagccagaaatgagccagtgccagagctgcaaagctttcctgctgataaacgggtcgtggcagttgtgggaacaaggcagcaaacagcggctggctgtaaggcagccagaaaatcagcgccacaaacagagcaatgagccagaacagcggatcgcgcaacatcttcatacgattacgcctcctccagcagatcctgaaaatgcagcgtgccgcaaggctcgccctgcgtgttcaccaccggcagcacctcgcatccccgcgcgacaaacagagaaagcgcatcgcgtagcgtcatcctttcttccagtgcctcaccttcagcccgttcttcacggcgcacgtaatctgccacgctacgtaacgaaagcaggcgtacacccagctcactacgaccaaaaaactggcggacaaaatcattcgccggatgagtcagcatcgtcagcggattgccctgctgcaccacttcaccgtgatccatcaacaccagatgttctgccagccgtagcgcctcatcaatatcatgagtgaccagcacaatggtacgccccagcaaacggtgtatgcgcgtcatctcttgttgcaacgcgccacgcgttaccgggtccagtgcaccgaatggctcatccatcagcaagacttgcggatcggcagccagtgcgcgcgccactcccacacgttgctgctgaccaccggaaagctgatgcggataacgctcacgcaaatttggctccagccccagtagcgccattaattcgtcgatacgatcgtcgatccgcgcccgtgaccatttttgtaattgcggcacggtggcaatattttgcgccacgctccagtggggaaacaggccaatagattgaatggcatagcccatccggcggcgcaactccagcactggcagcgagcgaatttcttctccggcaaagcggatcacgccactgtcatgctccaccaggcggttaatcattttcagagtggtggatttaccggagcctgatgtaccaatcagcaccgaaaaactcccctcctgaaaattgagattgagatcgttaacggctttttgtgtgccgaacagtttgctgacatggctaaattcaatcattacgtttcaccttcagcagtgcgataagcaaatcgaacagcgcgtcggtaagcaccgccagaacaattaccgggatcacccccagcaacactaaatcaatggcactgcttaacagcccctgaaaaaccagcgcaccaaaaccgcctgcgccgattaacgccgcaatcaccgccatgccaacggtttgcaccatcaccacccgcaggctgcgcagaaataccggtaacgccagcggcaactgaacatgcaggaaacgctgcgccccgctcatccccatcgctctggcgctctccagcacatcgcgcgggatctggttcaagccgactaccacgccgcgcaccagcggcagcaaggcatagagcaccagcgcaatcagtgcgggtgtcattccgattcctgctatgcccagcttacccagccacggaaaggccgtaaccagcgcggcaagcggcgcaatcagcaggccaaagagcgccaccgaaggcacggtctgaatgacattcagcagagaaaaaatcgccccctgccgcgcggtggaaaagtagcaccagatgcccaacggcacaccaatcactaacgcaggcagcaccgcaccaaacagcaacgtcagatgttgtgccagcgcgtcgtcaaacacatcctgacggttggcgtattctttcattaacgagagatcgttaagcgtgccggagtacagcaaccacagcggaacaatggcaatctgcatatgcaacaaccagcgccacagcggatgcgtggagattcggcggatggcatcgctacaggccagcagtgccagcgccgcagccagccagaaaccactgccgaggctggtacgcgccagcgcactgccattttgcgccagttgtgtcgccgcctttccagctccccacaccagcaatacgaagacgaattgcgccagaatgagtgcaaaaatgctgccttttttagcgggaataaaacaggctgtcagccaggcgcaaccaacgcccaccagcatccagagagtttgcggccacagctgccagagatgacgcccctcacccgaaactaaacgattaggtgcgtaactgataaacggcagcgccgctgcgattgccgtcagcaacagcagcagcgccagaacaggattaatacggaaataagtcacgggaaattacttcgtccaccctttttgtttcaggtagtcggctgccacttttttggcatccagtccttccactgcaatgctggcattcagctgctgcaatgttttttcatcgaggctggcgaagactggctgtagccactgtgctatttgcggatactctttcagcaccgactcacgcaccactggcgcaggcgcgtagataggttgcacgccttgcggatcgcttaaggtttgcagccccagcgccgcaaccgggccgtcggtgccgtaagccattgcggcattaacaccagaagtttgctgggcagcggctttgatcgtcaccgccgtgtcaccaccggccagtgacagcaactgatcctgaccgagcttaaagccataggctttttcaaacgcgggtaaggcatcggcgcgttcaataaactctgccgaggctgccagtttgaagttgccaccctctttcagataacgactcagctcggcaagcgaagtgagtttgtttttctctgccacatcctgacgcacggcgatggtccaggtgttatttgcaggcgcgggcgtcagccagattaacttgttttgctctgcatcgagttttttgactttctcatagccttgctgcgcgtttttccatgccgtatcgttttcatctttaaagaaaaacgcgccattgccagtatattccggatagatatccagctcgccagaagtgatcgccccgcgcactacgggagtcgttcccagctgcactttatttaccgtaggaacgccgtgactttccagcacctgcaaaatgatattgccgagcagcgcgccttccgtatcgatttttgaaccaaccttaacgggggaagccgcctgtagcggcaggctcacggctgccaacaaaaccagtgaacctgcccagacctttgagagtggcatgatgctttcctcattcttttactgttgttttcagcgaattaagagaaaagcatagttgataatggcggagttagcctgactgggtggactcagttgcagaatcagataaatacttaaaaggcatattttgcccggcgtttcttgccggatgcggcgtaaacgccttatccggcatacaaacatcgaaaattacaacaactcaaactcgcctttcttaacgcgtgcggaatcagtgccgatgaagacattgaacttgccaggctcggcatcatatttcatctgttgattccagaacttcagcgcctcaatatcgattgggaagctgacggtctgagtttcgcccggtttcagggtgattttctcaaagcctttcagctgcttcaccgggcgactcatggaagccgtcacatcctgcaagtacatctgtactaccgtcgccccttcgcgtttaccggtgttcgtcacctgcacgctggccgtcactttgccgtcacgcttcatggtcggcgcagaaagtttcacatcagagacggtgaaagtggtatagctcagaccatagccgaacggataaagcgccccgttagcttcatcaaaataacgcgaagtgtatttgttcggcttgtcggcattatacggacgcccggtattcagatggctgtagtacaccgggatctgcccgacagaacgcgggaaggacatcggcagcttgccggacgggttataatcgccaaacaatacatcggcaattgcattaccgccttcagtccccgcaaaccaggtttccagaatcgcatcagcctgctgatcttctttcaccagcgccagcggacgcccattcatcagcaccagcaccagcggtttaccggtggctttcagcgccgcaatcaagtcacgttggctttgcggaatagtgatatcggtacgactggaagcttcgtgcgccatcccctgagcttcaccgaccacagccaccaccacatcagattgtttcgcggtttgcaccgcttcatcaatcatctcttgcggcgaacgcggatcaactttgaccgcctcttcatactgattcaggaaatcgataatgcctttgtcactggtaacgttcgcccctttggcatacagcactttaccgttctcaccgacggcgtttttaatccctgttagcacagtaacagattgatcggcgacacctgctgccgaccagcttcccatcacgtcacgcttgctgtctgccagcgggccaaccaccgcaatggttgcagattttttcagcggcagcgtttcgagacggtttttcagcaacaccaggctttcgcgcgccacttcacgcgcttctttacggtgcaggcggctttcggcattggtatccaccgggtcagactctttcggccccaaatggctgtatgggtcgttaaacaatcccatatcatatttaacgttcagtacatggcgggcagcatcgtccagctcttccatcgtcactttgccggatttgatcaacccaggcagatacttcgagtaatactcgtcgctcatgctcatgttgattccggacttcagcgccacgcgtaccgcatcctctggatctgccgccgtgccatgtttaatcagctctttgattgcgccgtgatcggaaacggtgatgcctttaaagccccactggtcgcgcagaacatctttcagcagccaggagtcggaggtggctggcgtgccgttcagcgagttcagcgccaccatcaccgcaccgctgcctgcatccagccccgctttgtacggcggcatatagtcgttaaacaggcgctgcggactcatatcgacggtgttgtactctttaccgccttctaccgcgccgtatgcggcaaagtgtttgacgctggtcatcaccgagtaacgatctgccgggcttttaccctgcatcgcttccaccatggttttgcccattattgaggtgagatacgtatcttcgccaaaaccttcggaagcacgtccccagcgcggatcgcgcgagacatcgaccatcggtgcccaggtcatattcaggccatcatctgccgcttcataagcagagacacgcccgactgttttcaccgcatcgaggttaaaagacgaagccagaccgagactaatcgggaacaccgtgcgctgaccgtgcagcacgtcgtaagcaaagaaaagaggaattttcaggcggcttaattccatcacctgatcctgcatggcgcggatatcctgacgggttacagtgttgaaaatcgccccaacctgaccgtctttgatcatctcgcggatcgcctctttcgggttatccgggccgacgctgattaagcgcagctgaccaattttctcatcaactgtcattttcttaagcagttcggtgacgaacgcatcccgcgcttcgggcgttaatggatggttgccgaataaatcatccgccagtgctggctgcagggccagactcaccgcgattcctactgaacatagccatttcatatggatttttcttcctttgttgcccgacgtggcagcgaaaatggtgcaaaaaccgtagtttgccataagcatgatggagagagaaaaagaatgctcagtttattgtctgaattttcaaaatattcactcgctgaattgtcatacaaggcgctattctagtttgtgatattttttcgccaccacaaggagtggaaaatgtcttccatgacaacaactgataataaagcctttttgaatgaacttgcccgtcaggtcggtcattcacacctgctcaccgatcccgcaaaaacggcccgctatcgcaagggcttccgttctggtcagggcgacgcgctggctgtcgttttccctggctcactactggaattgtggcgggtgctgaaagcctgcgtcagcgctgacaaaattattctgatgcaggctgccaatacaggcctgaccgaaggatcgacgccaaacggtaacgattatgatcgcgatatcgtgatcatcagcaccctgcgtctcgacaagctgcacgttctcggcaagggcgaacaagtgctggcctatccgggcaccacgctctattcactggaaaaagccctcaaaccgctgggacgcgaaccgcactcagtgattggatcatcgtgtataggcgcatcggtcatcggcggtatttgtaacaactcgggcggctcgctggtgcaacgtggcccggcatataccgaaatgtcattattcgcgcgtataaatgaagacggcaaactgacgctggtgaaccatctggggattgatctgggcgaaacgccggagcagatccttagcaagctggatgacgatcgcatcaaagatgacgatgtgcgccacgatggtcgtcacgcccacgattatgactatgtccaccgcgttcgtgatattgaagccgacacgcccgcacgttataacgctgatccggatcggttatttgaatcttctggttgcgcagggaagctggccgtctttgcggtacgtcttgataccttcgaagcggaaaaaaatcagcaggtgttttatatcggcaccaaccagccggaagtgctgaccgaaatccgccgtcatattctggctaatttcgaaaatctgccggttgccggggaatatatgcaccgggatatctacgatattgcggaaaaatacggcaaagacaccttcctgatgattgataagttaggcaccgacaagatgccgttcttctttaatctcaagggacgcaccgatgcgatgctggagaaagtgaaattcttccgtccgcattttaccgaccgtgcaatgcaaaaattcggtcacctgttccccagccatttaccgccgcgcatgaaaaactggcgcgataaatacgagcatcatctgctgttaaaaatggcgggcgatggcgtcggtgaagccaaatcgtggctagtggattatttcaaacaggccgagggcgatttctttgtctgtacgccggaggaaggcagcaaagcgtttttacaccgtttcgccgctgcgggcgcagcaattcgttatcaggctgtgcattccgatgaagtcgaagacattctggcgctggatatcgctctgcggcgtaacgacaccgaatggtatgagcatttaccgccggagatcgacagccagctggtgcacaagctctattacggccattttatgtgctatgtcttccatcaggattacatcgtgaaaaaaggcgtggatgtgcatgcgttgaaagaacagatgctggaactgcttcagcagcgtggcgcgcaataccctgccgaacataacgtcggtcatttgtataaagcaccggagacgttgcagaagttttatcgcgagaacgatccgaccaacagtatgaatccggggatcggtaaaaccagtaagcggaaaaactggcaggaagtggagtaataataacggatggcagagtatcgccatccgtcattcatttaatcgttctgtgccgtctgccccgccgctgccatttgggcggctttttgttttttatagctcaacgctgctgccggaacaggcatcactttaccggtttcaatccaggtacgcaggcggctggcatcggcaaaatgggtatatttgccaaacgcgtccatcactaccagcgccaccggtttattattgataaccgtgcgcatcaccagacaatggcccgccgcattggtaaaaccggttttggttaactgaatattccagttatcacgatacaccagatggttagtattgcggaacggcagcgtatacgtcgggttagagaaggttgccatatcttcccgggtagtacttaactgcccgatcaacggatattgtttgctggcaataagtagtttggttaagtcacgggcggttgaaacgttatgcaccgacaatccggttggttcaacaaagcgcgtgttgttcattccgagcgatttcgctttcgcattcatcgccttaataaaggctttgtaaccaccgggataatggtgcgcaaggcttgccgccgcgcggttttctgaagacatcagcgccagcaacagcatatctttacggctgatttcgctgttcagtcgtacgcgcgaatagacccctttcatctccggcgtctggctgatatccacttttagtttttcatccagcggcagtcgtgcatccagcacaaccatcgcggtcattaatttgctgatagacgcaatcggacgcaccagatccgggtggttcgaatagatcactttgttggtattcagatcaacaatcatcgcgctaccggaggcaatttccggttgtgacgcggtggtagcggctgccgttttcgcaacggcctgcggtgcaaaaggcacagccagcatcagggccaggctaaataaagaaactcgaaatttcggcatgatgagcattcagatagtggttcacgcgcacgggttgcgcaccgccagagtaaggatttactgaggctagcgacgccatcataacgagcaaaaagtgcgatcgtcaaagaagaatcgtgaggaaatgctgcattgctgacatttacgccagcaatgcagcgcaaaagaactttctagaacaaacgataaccgtagccccatagtataacggtaagggcgagcagcacttccagcaccagcacgcctatcgccagtgtcgaactggagaagctaagtccttcctctttgttgatattcaggaagctcggaataccgagatacagcaggtagccggtgtaaaacagcgccaccgtgccgaccagcgcacacaaccagaccagcgggtaaagcgccaccagaccgcttaaaaacagcggagttgcaacgtagcccgcgaagaccatgcagtgcgcaagtgacggacgctgcggataattacgcgccatccaccagatgacccgccccatcaccgcaaccccagccagcataacgccgtaaaacaagacagccagcgccagtccggtaaaccaggataacttcaggatagtgccatcgccaaaattccagccaatctgtgtagtgccaatgaaggcgcaaatcaccggaatcgccgccatcagcaaaacgtggtgggtgtaatggtgagaaatcgtttcgttttcgcgattaatcacctgcatttcacgatcgggatgggaaaacagaccccagacatggctcataccgcccccttgttgtgagttcatgaacctgacagttcaagtataagtcagcttgtgattattttttgttcactcatgtaatttgcaccgtctgatgtacgtcctttttcagcgtgaatgattcacagggtgtatgcttacaggcaagcaaagggagacagactgtcctatggatctcaatacactcatctcacaatatggttatgccgcgctggtgatcggtagcctggcggaaggtgaaaccgtgactttgctgggaggcgttgcggcacatcaggggctattaaagttcccgctggtggtactttctgtggcgcttggcggcatgattggcgaccaggtgctttatctgtgcgggcggcggtttggcggcaagctgttacgccgtttctcgaaacatcaggataaaattgagcgggcgcagaaacttatccaacgccatccgtatctgtttgtcattggtacgcgttttatgtatggctttcgggtcattggcccgacgctgattggtgccagccagctgccgccgaaaatctttctgccgctgaatattctcggcgcatttgcctggtcgctgatttttaccactatcggttacgctggtgggcaggtgattgcgccgtggttgcacaatctcgaccagcatttgaagcactgggtctggttgattctggtcgtagttctggtggtaggcgtgcgctggtggctgaaacggcgcgggaagaaaaagccggatcatcaggcgtaaaactattgccctggataaggtgttcgcgccgcatccgacatccggtgcaccatgcctgatgcgacgctggcgtgtcttatctggcctaacccaatgaaataaccactcacctcattgcgctactccggcttaaactgcggatttgccagcataaaaccgccatcgacaatcagcgactgcccggtggtgtaattggcgccttcggaacatagccaggccaccaggctggcaatctcatgcgttgtgccaaaacgtcgcaagggaatcgaaggctccgcgtcgggcttcacgtcgccgccatccatgccgttcattggcgtggcgatcgccccaggtgcgactgcgttcaccaaaattttatgcctgaccaactccagcgccattgctttggttaacccgccgagcgcatgtttagcggctgtgtaggcgctggcatccggcagcggcgtatgttcatgtaccgatgtaatgttgatgatgcgaccgccctgcccttgcttcaccatctggcgggcagcaatttgcgagcataaaaatgcaccatcgacatcaacggtaaaaatcttgcgccactcatcgaaagccatatcaagaaacggcgctttggtcattgcgcccgcattattcaccagcacatcaatacgccccagccgttgaataagtttctccagcgcctgcgcaccttctggtagattgccgagatccagttgcacgatctccgcacgtacgccgtggctaactacctcacgcgcggtatcttttgccccttcttcatctgagtgccaggtaatgccaatatcaaacccctgctgcgccagcaataacgcgcactctttgccgatccccgaatcggaggcggtaattatcgcgacctgtgccatcgagttctccacttaacgctcaacaaacgttaagtatagaaggcgcatatcatcagcgtttgtaccccccgcccagcgcaccagtgagttgaatggaggcatccagccactgcccttgcaataacaggccattggcccgctcacgcagcgccgggattctggcttcgctgacccgggaaccagcaatgaggcccgcgttaaagcgggcctgcgcaagacctactacacgcaaggcatcgcgctcaatttgcgcctgatgctggtttttctccgccagtgtctgaacctgactggctgcccgcgccacgtcattcaccgcttcaaccaccgctttgttgtagctggcgatagacaagttgctttcggcttttgcgatatcgaggttggcgttaagacgaccactatcgaaaatgggtagcgtcaggcctgccgtaacgcccatttgctgcgcggaatgacggaacagatcgcttaagtgcaacgcatcctgttgcaggaaggccatcaggttgatgtcaggataaaatgccgcttttgccgcatcaatagtgcttaacgatgactcaacgtaccagtgcgccgcctgcaaatctgcccgccgcgccagtaaggagtaccccagttcatcaggaagctggcttgccactttcggcaacgcgaccggtttaagcttcagtgactttgtctggtgatttgtgagtgcatttaaccgtgcctcaataattttcattttacccgcgacatcgttgagctgctgccgggttttgctggcattaatatcggtttccacaccttcaactgaagaagtaatcccgttctgatatagctggcgatcggtcgcgataatggtgttctgctctttttcgatttgctgcaagaccgtgtttaacgccgcctggttttgccactcccagtacaggcgggctacgctgccagccagcaattggcgggtttgctcgcgttccgccgcccgtgctttaaccgtacccaggcgagcagtaacctccgcccgattctttccccagatatcgagatgccagcccgccgttaagccaaaagtaccgttggtgtaccacggaccggtcgtacctgcggccggatcgttcaaagcaaacggccccattaacccttctgccgacattttttgccgctccatatccgcagaaaagtcgagctgcggaccatcctgagtggcaactgccttcgcctgggcttcagccagctgaatgcgctgttcagccacctgcatatccggtgcgctctgtagtgcgttattaattaaggaagtgagttgattatcgtgatactccagccaccattggctgtctggccaaccatttttcagcgccgtgggtaatacggtgtcaacttgtgcagcgggcgtttgctggcttaacgcctggcgggtttcatgcataggcgcacacccggccagcatcagtaacagcgaaaaacaggcgatggcgggataaaaggaatcacgattcatgggggaataatcaggtaagaaaaggtgcgcggagattaccgtgtgttgcgatatattttttagtttcgcgtggcaatacatcagtagcaataaaacgacatatccagaaaaatatacactaagtgaatgatatctttcgatttatcttaatcgtttatggataacggcaaagggcttcgttttttcctatacttattcagcactcacaaataaaggaacgccaatgaaaattatactctgggctgtattgattattttcctgattgggctactggtggtgactggcgtatttaagatgatattttaaaaatcagatatggcatataagttgtcaggtcagtaactcgatattttgtgtacttgatttgcaaacagctccggtgttggtggcgttaaaatcgctgaagcgttccccgaaggccggggcagcccacatggatgtgggctgagggcgcgtcttacaaggataatgagatggacgctccagattttacggtatcaaagtaccagactggatcgttgcaatacgtcctgaaaaattaggagcgtccacatgaaagtatcaactcttggtatcgacctggcaaagaacgtttttcagcttcatggtgtcgatcatgaaggccatactattttgcgtaaaaaactcacccgggctaagtttgttcagtttgtgattcaactggaaccttgtctgattggcatggaagcctgctcatccagtcattattttgcgcgattattcacccgctatggtcatgaggtaaaactcatacctccgcagtatgtgaagccttatgtgaaaacgaacaagacggatgcagcagatgctgaagcaatctgcgaagcggtaacccgtccgaatatgcgttttgttcagataaaaaccgaagagcagcaggccgttttagcgttacacactgaacggggaatacttatccgtgagcggattgcctgtgccaatagtttaagagccacacttgctgagtttggtattacgattgcggccggacaaagccatttaacccgtgagctgccagccattctggaggatggcgaaaatggtttatctccctttgtcagaaccagcatctacagacagtctaaacatatccgggaacttgaagaacaagttaaacaggtagaagaagctctggcctcctggtatagaacgcaggaagcctgccagagaatggccaaaatcccgggggttggcatgttaacggccacttatgtggtagcagcagtgggtaatgcccgacaattcagtaccgcaaagcagttcgcttcatggctggggctgacaccaaaggaatattccagcggcgggaaacagcaactgggagggatcagcaaacgtggagatggatatttccgatacctgctggttcacggcgcacgcgcacttaccgcctgggtcaaccgaaacggcgcggttgaggagaattcctggcttcagggactccttgagcggaagcactacaatgtggctgttgtcgccatggcggcaaaaacagcgaggatcatgtggtcaatgttgtcacacaatactgaatatcaacctcggcagctcgcctggcacaaggtcagtcaatctgacgaggtgctgaaaaaaagttaacgtcctggtaggtgcaggtgacttcagaagatggcaaaacaggtaagaccgcaggcaggatacaccgagaggtaacaagggcaagttagcccgtagaggatgattggtacctgcctggcggatttcatcatggttcgggataaaaatcccatcagaaaccggatatatggctgcacctacccgttttattacataactgaagaaagcattgcattccgggagcgtccatatacgttacctcgcgcccgacccggtagccgaaggggataagctgaaggtaccgcgcagcggcgattttgttcgccagagcccgggggtgcagggggaggaggcgattgtcctccccctgcgcgctccttgcgccagtggcaatatgtggcttagctcatgaaaggagcgcaacaagatgatgaagctgaataagcgattcattgtctcagataagctgcgattccactattatcgcagcttatcgatatcaatggcctgaatagcccttgcaatatcaggggaattattcaacacccgaacatgctgaaataattccgttgcttcatcgtattctttacgcaaataactcaaccactgtttaatccgcgcaacgtgatataacccggtatcgccctgcttttccagacgggtatatttttgcagcaaagcaaccacctccggccacggcattcgcggttcgttatatttcaccacacggctcaggttgggaatattgagcgccccgcgaccaatcatcactgcgtcgcagccgctgatcgccatgcattgttgcgcactctgccagtcccagatttcaccgttggcaatcaccggaatattaagccgctggcgaatctcgccaatcgcctgccagtcaatatgttccgcgcggtaaccctgctcttttgtccgcccatgtactaccagctccgtagcaccagcctgttgaaccgcatcggcgatttcaaatttcttctcaccgctgtcccagcccagacgcacttttacgctgacaggcaaatgcgccggtacagcttcgcgcatcgcttttgcaccctggtagatgagttcaggatctttcagtaacgttgccccaccaccgctaccgttaaccgttttcgacgggcagccgcagttaagatccacgccccaggaacctaactccaccgcacgggcggcgttctctgccagccactgcgggaactgccctaacaactgcacgcgaaccagcgtaccggatggtgtccggctggcattttgtagctcagggcaaatgcgatgaaagacttttactggcagcagttgatccaccacgcggacaaactcggtgatgcacagatcgtagtcgttaacttcggtcagtaattcccgcaccagagagtcaagtacaccctccatcggagccagtaacacacgcatatcatcacccgcaaaaaaatgaggcgctatgttagcgcctccggtcaacggattaaaggtctgcaaagagggattgctgcaaactgcaatccctctctatgcttgatgtatgcctgagttcgctgcgcattgcgtaataccggggagcgaaaaaataagcgctgatttcttaatgtgatcggtagcacgttttacgaattaattgtatgatgaatccatctcatctggggtgttgattatgagtaagacactgaacattatctggcaatatttacgtgcttttgtcctgatttatgcctgcctgtatgcaggcattttcattgcttccctgctaccggtaaccattccgggcagcatcatcgggatgctgatcctgtttgtcctgctggccttgcaaattcttccggcgaaatgggtcaatccggggtgctacgtactgattcgctatatggcgctattgtttgtgccgattggtgtaggcgtcatgcaatattttgatttgctccgcgcacagtttggtccggtagtggtttcctgtgcagtcagtacgctggtggtttttctggtggtgagctggagttcacaactggtgcacggtgaacgtaaagtcgtaggtcagaaaggatcagaagaatgatggcgaatatctggtggtcattaccgctgacgttgattgtcttttttgccgcccgcaaactggcggcacggtataagtttcccctgcttaacccgttgctggtagcaatggtggtgatcattccttttttaatgctgactggcatctcttacgacagctactttaaaggtagcgaagtgctaaacgatctgctgcaaccggcggtcgtcgcactggcctatcctttatatgagcagctacaccagatccgcgcgcgctggaaatcgatcatcaccatctgttttatcggcagcgtggttgcgatggtgacggggacttctgtggcattgttgatgggcgcttcaccggaaatcgccgcgtcaatcctgccgaaatcagtcaccacgcctattgcaatggcagttggcggcagtattggcggtattccggcaatcagcgcagtttgcgtgattttcgtcggcatcctcggcgctgtgtttggccatacattgcttaatgcgatgcgtattcgtaccaaagctgcgcgcggtctggcaatgggcacagcctcgcacgccctcggtacggcgcgctgcgccgagctggattatcaggaaggtgcatttagttcgctggcgctggtgttatgcgggattattacttcgctgatcgcaccgttccttttcccgattattctggcagtaatgggctaaaatttgcgatgcgtcgcgcatttttgatgtaagtttcacgcgttgcataattaatgagatttagatcacatataaagccataacgggttcgtaaactgttatcccattacatgattatgaggcaacgccatgcatccacgttttcaaaccgcttttgcccaacttgcggataacttgcaatctgcactggaacctattctggcagacaagtacttccccgctttgttgaccggggagcaagtctcatcgctgaagagcgcaacggggctggacgaagacgcgctggcattcgcactacttccgctggcggcagcctgtgcgcgtacgccattgtcgaattttaatgttggcgcaattgcgcgcggtgtgagcggaacctggtatttcggtgccaatatggaatttattggtgcgacaatgcagcaaaccgttcatgccgaacaaagcgcgatcagccacgcctggctgagtggtgaaaaagcgcttgcagccatcaccgttaactacacgccttgtggtcactgccgtcagtttatgaatgaactgaacagcggtctggatctgcgtattcatcttccgggacgcgaggcacacgcgctgcgtgactatctaccggatgcctttgggccgaaagatctggagattaaaacgctgctgatggacgagcaggatcacggctatgcgctgactggtgatgcgctttctcaggcggcgattgcggcggcaaaccgttcgcacatgccttacagtaagtcgccaagcggtgtcgcgctggaatgtaaagacggtcgtattttcagcggcagctacgctgaaaacgccgcattcaacccgactctgccgccgttgcagggggcgttaattctgttgaatctcaagggttatgattacccggatatccagcgcgcggttctggcagaaaaagccgatgcgccgttgattcagtgggatgccacctccgcaacgctgaaagctctcggctgtcacaatatcgaccgcgtgcttctcgcttaagcctggtaccggatgcggcgtgaacgccttgtccggcttgccagccctttcctggtgtcgaaaatcccggcaaacagtttgccgtttcttgcgcaaaaccagcgggtaaagtagcctgatggaaattttccttagatcgagtctcctgcatgttaaagcgcgtgttcctcagcctgttagtcctgatcggcttgctgctgttgactgtgctcggcctcgatcgctggatgagctggaaaaccgcgccttatatctacgacgaattgcaggatctcccctaccgccaggtcggcgtggtgctcggcacagcaaaatattatcgtactggcgtaattaatcagtattatcgctaccgcattcaaggagcgattaatgcctataacagcggtaaggtaaattatctattactgagcggcgataacgcattgcaaagttataatgagccgatgaccatgcgcaaagatttaatcgcagctggtgtcgacccatcagatattgttctcgattacgcaggctttcgtacgctggattccatcgtacgtacacgcaaagttttcgatactaatgatttcattattatcacccaacgtttccactgtgagcgggcattatttattgcgctgcatatggggattcaggctcagtgttatgccgtaccgtcaccgaaagatatgctgtcagtacgtattcgcgaatttgccgcccgtttcggtgcgctggctgacctttatatttttaaacgtgaaccgcgttttttagggccgctggtccctattccggctatgcaccaggtgccggaagatgcgcaggggtatcccgccgtcacacccgaacagttacttgaattacaaaagaaacaaggaaagtagttatggatgtacagcagttttttgtcgttgccgtttttttccttatcccgatattttgtttccgcgaagcatggaaaggctggcgcgcaggcgcgattgataaacgggttaaaaatgcaccggaaccggtgtatgtctggcgagcgaaaaatcccggactcttcttcgcttatatggtggcatatatcggcttcggaattttatctatcggcatgattgtttatcttattttctatcgttaatattttcccttttctgttaattattgagaataattattacttcactcaataagctgcggatataacattctgaaccgcagctatttgtgaatcctttcacagtttaaatttccccacgcgcatagccttaatatcagcacgcaatatttatttagcgttcgccttaattactcatagcattaaggaagatcacatgccgcaacaaaattatctggatgaactcactccggcttttacgcctttactggcgattaaagaagcctctcgctgtttattatgtcatgacgctccctgtagtcaggcttgcccggcacagaccgatccggggaaatttattcgctcaatctactttcgtaattttaaaggcgctgccgagacaattcgcgaaaataatgccctcggtgccgtttgtgccagagtgtgcccgacggagaaattatgccaaagcggttgtacacgtgccggtgttgatgctcccattgatatcggtcgcttacagcgttttgttactgattttgaacaacaaactgggatggaaatttatctgcccggtactaaaacgctcggcaaagtcgccattattggcgcaggtcctgccggattgcaggccagtgtgacgctgacaaaccagggttatgacgtcacgatctatgagaaagaagcacaacccggtggctggttgcgtaacggcattccgcaattccggttaccgcaatcggtgctggatgcagaaatcgcccgtatagaaaaaatgggcgtgaccattaagtgcaataacgaaatcggtaaaacactcaccctggagcagctgaaagcggaaaaccgcgcggtactggtcaccgtagggttatcgagcggttccgggttatcgctgtttgagcatagcgacgttgagattgccgtcgacttcctgcaacgtgcacgacaggcgcaaggcgatatcagcattccacaaagcgcattaattatcggcggcggtgatgttgcgatggacgtagccagcacgctgaaagttctcggctgtcaggcggtaacctgcgtagcgcgtgaagagttagatgagtttccggcaagcgaaaaagagtttaccagcgccagagagctgggcgtttcgatcatcgatggatttacaccagtagccgtggaaggcaataaagtcacctttaagcatgttcgtttaccgggcgaactgacgatggcggcagataaaattattctcgccgtcggtcagcatgccagactggatgcctttgcggagttagagccgcagcgtaacaccatcgaaacgcaacattaccagacccgcgacccgcaagtctttgctgctggcgatattgttgagggtgacaaaaccgtggtctatgcagtgaaaaccgggaaagaagccgccggggcgattcatcactatttagagggagcttgctcatgttaacgaaagatctttcgattactttttgcggcgtgaagtttcccaacccgttctgcctttcttcttcgccggtaggcaactgctatgagatgtgtgccaaagcctacgacacaggttggggcggcgtggtgtttaaaacgatcggtttttttatcgccaacgaagtctcgccgcgttttgatcatctggtgaaagaagataccggttttatcggcttcaaaaatatggagcagattgctgaacatccgttggaagagaatctggccgccctgcgtcggctgaaagaggattatccggacaaagtattgatcgcttcaatcatgggcgaaaatgagcagcaatgggaagagctggcgcgtctggtgcaagaagctggcgcggatatgatcgagtgtaacttctcctgtccgcaaatgacttctcatgcgatgggtagcgatgtcgggcaaagcccggagctggtagaaaaatattgtcgggcagtaaaacgtggttccacgctgccaatgctggcgaagatgacgccgaatattggtgatatgtgcgaagtggcgctggcggcgaagcgcggcggcgcagatggcattgcggcgattaacaccgttaaatccatcaccaatatcgatcttaatcagaaaattggtatgccgatcgttaacggtaaatcgagtatttccggatattccggtaaagcggtaaaaccgatcgccctacgctttattcagcaaatgcgcacccatccagaactgcgcgatttcccgatcagcggtatcggcggcattgaaacctgggaagatacggcggagtttttattgctcggtgcagcgacgttgcaggtgaccaccggcattatgcagtacgggtatcggatagtggaagatatggcaagcgggttgtcgcattatctcgccgatcaagggtttgattcgttgcaggagatggtaggtctggcgaatcacaatattgtcccggcggaagatttagaccgcagttatattgtctatccccatatcaatcttgataaatgtgttggctgtggacgctgttatatttcctgttacgacggcggtcaccaggcgatggaatggagcgagaaaacccgcacaccgcattgtaataccgagaaatgcgtgggttgtctgctttgtggtcatgtctgcccggtaggttgtattgatcttggggaagtgaagtttaagaaaggcgagaaagaacacccggtaacgttgtaaaaccagcgacgcatccggcatttagttcctgtcgccggatgcggcgtgaacgccttacccggcatacaaaacaatataaatcagtatgttgtgctcattgtaggccggataaaacgcgccagcgttgcatccggcatttggttcctgtcgccggatgcggcgtaaacgccttatccggcatacaaaaccatacaactcatgatgttatgtgcatttctgaccggatgcgaaccacattcacatcacttcttacgcgcgtatttcagtgaatccagcgccacggcgaagataataatcgcccctttgatgatgtactgccagtacgggtttacgccgatgtacgtcaggccatagttgatgacggtaaaaataatcaccccggtcacaacaccaattaccgtccccacaccgccgctgaacgatacgccgcctaccacgcacgccgcgatagcatccagctcatacataaagccgaggttgttggtggctgagccgatacgtccggcttctaacatcccgccgaaggcatagaacacaccagacaacgcgtagatcatcagcaggttcaggccgacgttgacaccagatactttcgccgcttccgggttaccgccaatggcaaaaatgttcttaccgaagcgggttttgttccataacacccagacaaacaccaccgcaatcaacgcatagaaggtgatgtaagagagacggaaactccccagcgcgacaaagccttgagcaaaggtagagaagccactgtcaaaaccggaaattggcgacgccccgacaaagtcgtaatagagcgagttaatgccgtagacgataatcatcgtgccgagcgtggtaatgaacggcgtcacgttgagataggcgataatcagcccgttgatcaaaccgatcaccgcaccaatggcacagacaatcagaataaccagcgcaatcggcatcgtcgccatttccgggaacactttgttagcgttatccatggactgcaataacgtcgctgctactactgccgccagccccacctggcgacctgcggaaaggtcagtcccctgggtgacaattaaccctgccacaccaagcgcgataataatacgcaccgatgactgggtgagaatattacttaagttcaacagacttaaaaatgttgggtcctggaaaataataatcgccagcaaaactaaaagaacgacgtaaataccgccctctttcaggtaagtaagaaaacttttcttatttaacgcactcatgggaagcccctaatcttaaaggtgcaaagacgcaagacgcagaatttcgctttgcgttgttgtttttgtatcgacaattccggaaacgagaccattgctcataaccagaatacggtctgttatccctaacaactctggcatttcggaggagataataataatccccttgcctttcttcgccagttcggcaattaactgataaatctcaaacttagccccaacatcaataccgcgcgtcggttcatcgagcattaatatttctggttgcgttaacagccagcgaccaataatcactttttgctgattaccaccggagagcgaaccaatttgcgtccgatgccccggtgtttttacccgcatcgaatcaatcacccactgggtatcgcttttcatccgcgagttatccagtaaaccaactttatttttatagttgcggatattggaaattaacgagttaaagccaatatccagataggcataaattcccgttgagcggcgctcttcagttaccagtgcaaatccgtggtttatggcttcgttggcattatggttattgatctttttgccgtgcaacgtaatggtgccagccgatttctcgcgaataccaaataacgtctcaacaatatcggtacgtttcgctcccaccagaccggctataccgagaatctcccctttatgcagatcaaacgagacatcgcgtatcgacggctggcgcagcgacgtcaggttacgcacttccagaatcacttcgcccggcttgttttctttgtcagggaaacgctgattaagagaacgcccaaccatcatggcgatgatcttgtccatcgtcagtcctgccagcggttcggtagcgatccactgaccgtcgcgcaatacggtaacttcatcacataactggaagatttcttccattttatgcgagatataaacaataccgcagccgcgctcttttaatttacgaataatagtgaacagatgattgacctctttttcggttaacgaagaagtcggttcatccataatcacaattttcgcgttataggaaaacgctttggcgatttcgatcatctgcatttgcgaaacagataatgtaccgacgcgcgcacgcggatcgatatcaatatccagttcatcaaaaatcgctttggtttcgcggtacattttgtcctgatcgacaaacatgcctttggtgggatatcgccccagccacatgttgtccatcaccgaacgttgtaataccaggtttaactcctgatgtaccatcgaaataccattttccagtgcttctttggcggaatggaaatcgatctctttaccctggaataaaatggtgccggagtctttttgataaataccaaacaggcattttaataatgttgattttcccgcaccattttcccccattaatgcatggatagaatgtggtcggacttttaagttaacgttatcaagtgccttaacaccaggaaaagacttgttgataccgctcatttccaacaagtattccccggaagacggagtcgttgagctgaccatataattttaccttgttggccatacaataagggcgcagtaaacgactgcgcccaatcagtcttatttcttgctgaattcagccaggttgtctttatctacgccaacataaggtacgcggactactttgttgtcgattttccagttggtgccatcagccgcacctttgccatcggccaggtttttcgccagatcaaaggtcgctttcgcctggttgttagcatcgttcagtacggtgcccgccagtgcaccggatttcaccagcgccagcgcttctggcagcgcatcgacgccaaacaccggaatgctggacttgttgtgtgctttcagtgcttctaccgcgcccattgccatcgcgtcgttgttggcgataaccacctcgattttgttggcgttcgggccagacagccaggcgtccatcttatctttcgcctgagcggtatcccacatagcggtatctaactgtaactgttcagttttaatgcctttgtcgttcaattctttaatcacgtaagtggtacgtgcttctgcatccggatgccccggctcacctttcagcagtacgaattgaatctgaccgtctttgttcagatcccaaccctgattcgccgcccagtgtttagcaatcaaatcaccctgaataatgccggactctttggagtcagtgccaacgtagtaggctttgtcgtagctatccagcgccttacgagacggttctttgttgaagaaaaccaccggcacgttttgcccacgcgctttctcaatcaccgtacccgcagctgccgggtcaaccaggttgattgccagtgccttcacccctttcgccagcaatacgtcgatctgatcgttctgcttggactggtcattctgagaatcattcatcagcagctgaacatctggcgcggctttcgcatcttgctcaatagccttgcgcactacagacataaagttatcgtcgtacttatagattgttacaccaatgcgagtatcagcagcgtgtgcagcggcaccgaataacatgctggccatcacagcagacagggttaacaccttcttattcatggtatctccggtttttcttatgcagggtagtgcttgagataaatgctcggcggggcagtagagttaatgaagtgttactgaacgccgaagctcactttttaaaattcgttcttccatgcccggtaacgctccagaaaacggctttaattgttgttatgacgctattacctcggtgaaagtgattattcactgttacatacgggttacaacgttaaaacggtgcaatcatagccatcacattgttaagatactgtgaaatcactcacagattgaaagcggttacatcgcctgatttgttgagttagtgatcgccgccgcattctggcgtgttgcgacagaatggcgacgcactaacgtcggcataaaacagtggctggcacgaggatcaatattgtctgctgccccctgcaaggccagttcggtagctaatttagccattgaagcaatgggataacgcacagtcgttaattgcgggtcggtgtaacgggcgatgggaatatcatcgaaaccaatgattgagagatgtaacggaatcgcaatgccattatcttttaatgctgtcagtgcgccagcggccatattgtcgttataagcaaatacagcggttagttgtagattgcgccccagcagttcaaccatcgccgcctcaccgcccggcatgtccggcgtgccagtgccaatccagctttccggcggaataatatcctgctctttcaacgcactcatccagcctgctttacgcatggcgtcatcttcaatgccgtggctggaagaaagataaccaatacgttgatgaccgttattcagcaacatgcgcgtcgccattcgggcaccgctgagattatccaggcaaacgcaacgatgggcgtaccccggcacaacgcggttgattaacaccataccgggaatgttatccataaattgtgccagttcatcgtcactcaatgcttttgagtgaacaatcaacgcattacaacgctggcgaattaacacctcaatggcgtgacgctctttttccgcttcatgatagctattgccgattagcacgtatttctgatgctgctgggcgaccagatccaccgcttttaccagcgcgccgaaaaacgcatcagaaacgtccatcaccaccacgccaatggtatcgctaacctgagttgccagcgcctgggcattggcgtttggccgataatccagctcactcacggctttcattactgcttcacgcgtatcggcactgaccagcgtgctgttattgagcacccgggaaaccgttgccacagagacgccagcctgacgcgctacatcacgaatggtgatcatattcactacctgttatgagattgcagtaaatgactgcttgctggcggctattttgtcagcactgaatacaggacttcgtgaatcgagtcacagcaatggaaacggttacagccgttttgttaacgaatgtgatccagatcgttatcttgatgttttagatattgtcggtccggcagcacgcaaagttaactgacgccagagccattccaccggcccctggcggaagtaacgcagccagataacagagaagaagatattcgccaaccataccggaataacaaacgccagcagctccagacggtcaaactgcataaacaaaccgaggtggtaaaaaagcgtagtacaaatcagcgtttgcaatagatagttggtcagtgccatccgtccgacacaggcgattgccagcaccagcttaaagcggcttaattgcggccagaagccataaaacagcgacgcatagccaatcgcctgaaacggcgcactcagttcccgcggcatctgaagtaagaaggcgcaccaacgatacgcccagtccagtcgccattgcagggcgatggcaggaaggttaatgatcactccaatcgccaccagcacaaaaccagtacgacgatagtgacgtaagctgaactgccctttcagccagccactgcgcatcaatgcggcaccaatgagcatcatccctgccagttgccagccatactgtgcgcccagtgccagtaaactgttgccaacaccatcggcacgattactgatcgcttcaacaccaccgtgaagtttccagtgcttttcatacaaaatagccgatgtatcaggtgtccaggcgcggctggtctggctatcggaaatcccccccaataacagcaaaacgccaagccccaccagataaagcatgacgccggtattaaacaggctttttaccgatggcgcatcgcgcaccagccgccagcagattaagcccaccagcccgtaagccagcagaatatcgccgtcccagaacaataaaccgtgaataaagcccagcaagactaacagcgttaaccgcgactggatccatcgtctgccacggggcagcaacatttgcaggcccgcaccaaacaacagcgcaaaaagcgtgaggaatttcacctggccgatgagatcgagaaatgcccaggtccatgcatcctgtggcgtaatagcgccgtaccaggcgggattgagataagccgcctttggtaacccaaaggcgctgatgtttaatagcaggatccccagaatggcgacgccgcgaacaaaatcgagcgtgacgttgcgctccacggttcctgcctttttatcagttgtgatgacgcacagcgcgcagaaactcgtggcgcgtattctgactggatttgaacaatccaccaagagaggtcgttgtcgtggcactggttgcatcgcggatgccacgcgccttcacgcagtaatgcaccgcgtcgatagagacagccacattattggtgcccagcagcgtttgtagcgcaatgagaatttgctgcgtcagacgttcttgtacctgcggacgctgggcaaagaactgcacaatacggttaatttttgacagaccaatgaccgaatctttcgggatataggccaccgtcgctttgccatcgatggtaacaaaatggtgttcacaggtgctggtcagagtgatatcgcgcacggtgaccatttcatcgaccttcattttgttttcaatgagggtgattttcgggaaattggcgtaatccagaccggagaaaatttcatcgacatacattttagcgatgcgatgcggcgtttccatcaaactgtcatcagccaggtcgagattcagcagctgcatgatttcggtcatatgaccagcaataaggcttttgcgcgtttcgttatccatttcatgcacgggcgggcgcagcggtgtttccagtcctcgcgcaactaacgcttcatgaaccagggccgcttctttactgagtgatggcatttatgatttctcctgcaggtgtgacgcctccgccctgcgtgggggcaaagttattaagctgatttacagcctgattattgtgcgtgaggcggcgcacataatccagtattcacagcgataattattgtaattgccgctgcctttcatcagcagatgttaaaacatcgttatgcaaatacggaagtgaaagttactcacagcacattgaataaacggtatgatgaagaaattgcaaacaacacaacaaggagccacgcatggaaatgctcgaagagcaccgctgttttgaaggctggcagcaacgctggcgacacgactccagtaccttaaactgcccgatgacgttcagtatctttctcccaccacctcgtgatcacaccccgccaccagtgctgtactggctttccggattaacctgcaatgacgagaacttcaccaccaaggcgggtgcccagcgcgtggcggcggaactggggattgtactggtgatgccagacaccagcccgcgcggcgaacaggttgccaacgacgatggctacgatttaggccagggcgcggggttttatcttaacgccacgcaaccaccgtgggcgacacattaccggatgtatgattatctgcgcgatgaattaccggcactgattcagtcgcaatttaatgtcagcgaccgctgcgccattagcggtcattccatgggtggtcacggtgcactgattatggcgctgaaaaatccgggtaaatacaccagcgtttccgcctttgcgccaattgtgaatccgtgcagcgtcccgtggggaatcaaagcgtttagcacttatttaggtgaggacaaaaatgcatggctggaatgggacagttgcgcgttgatgtatgccagtaacgcgcaggatgcaatcccgacgcttattgatcagggtgataatgatcagtttcttgctgaccaactgcaacctgcagtactggcagaagccgcgcgccagaaagcgtggccgatgacgctgcgtattcagccgggatatgatcacagttactacttcatcgcctcttttatagaggatcacctgcgcttccatgcgcagtatttactgaagtgaaagtccgcccggttcgccgggcatcttctcatcagaagcgataatccactgccataaagtaacgacgtccgtcttcgttatagctgtagtcgtcacgactgagatccttgtcgccaaggttcagcacgcctgcgcgcagtttgacgtctttagtcacctgccaggccgcgccggtattccagatggtataaccgcccggtgttttagccgtcgcgctgtcggcgcgtttctgcccggtatagtgaccagaaacatagaatgaccagtcttccagcgccagcggtttccagtccagcgtaccgttagcagtatggaacggcagatcggatagcggtttgttttcgccgttgctgacatcacgaccatcgttgtaggtgtagttgatcgacagtttccattcatcgttgaacggaattttcagttcggtttccacgccctgaatacgagctttgttaacgttgtagtagctaaataccggtatgcgccgtccgttagcgcccgtctcaaaaccgacaaagttttggtagcccggtgcagcattgacgtcagacgtacggctaatgctgatacgatctttcacatcgttacggaaaacggtaacgctggattcaaccccttccagccagccttcttcacccatgtagtaaagccccagctcccaactttcgctggtttctggtttcagatccgggctacccacaatcttacatgcgccacggcaggaattgctcgtccagtcagggctaagttgcaacagagaaggggctttaaatgccgtcgcccagccccctttcaccgttacggtgtcggtggcgttataaaccaggtaggcacgcggactccagtgttcaccgtaggtttcgtgatcgtccatacgcacgccggtcgtcagcgccagcggctcgaagatccgccattcatcttccacaaacagcgcgtactggctggcagacgttttggagctggttcccccggtcaggttcaccgcatcgctaagtttgtcgtgacgccattcaccgccaaccgtgagaaactgattaatcgccgtcagcggcaacgtgtatttgccgtcgaccgtattgctttcggaagttatcgggctgctgttgccagggtttttgttctcgactttctcaccgtagtatttcagttcgctggtgccgtaatcccaacgcccattatggctgacggagtagttctggcgttccaggcggtttttgtccagcgagtcggaatcacgatcctgacggtcgaaaccgtatccggcagtaaaatcgtgattttgattcggtgtccaggcaaattcgacattgccgtcgcggctggagaatccttcaatacgcggcgtttctccggtatcggtggtcgttgagttttgcgggtcatccttttcacgttttgccaggctgccgtaagctttcattcccagcacgccgtcaattaatggtccgctggtaaagaattgaccgttataggtatcaccgcgatcgcgatgttcctgaacggtggtatcgacggtaacggtgcccgaccatttctgaccgatttttttggtgatgatattcactacaccgccgagcgcatcggaaccgtacagcgacgacatcgggccacgaaccacttcaatacgttcgatggaatcgaccgggatccagttcagatcgaaatcattgtggcggaagacggcattgcgggagttaacgcgtttaccgtcgacaagaatcagggtgtagctgctgtccagaccacgaatacttacgcccttacggttatccccttcgttcgtcagttgtacgccaggcacttctttgaggacatccttcagattctgtaccggttttcgctgcaggtcttcctgggtaatgacgctgatactggcgggagcatctttaaggttttgttcaacggaagatgcagtgacaaccatcgtttcgccatcatcatcgaccgctaacacaggctatgcacaagaaatagcggacaaacacagcccgacccgtacgaaagggttcaacctaaacattccatatctccatgaggtaactacgaaaataaaatgggtatcgctcacatcttctttacgtccccttgcgtacggcagcatcgcggtggacttatttgtatgcaggtgatcatcccagaaagccggaacagcctctgatttgtcagccttttttgattgcggcgtaacgataatgcaaacgataacaattatcaatccaagtgttaaattttatatccgcatgatttgtcagggaaatggaattgaaaaagccctctcggttgagagggcttagcaaggaagcgaggaaacttatttcttatcgttctgcgggaacttcatttcgctgtagcgtacgaagtgagttcctttaatcagcttgtagccgaaccaaataatcaggaacagcgggataccaatatacgttgccgctacgccgccccagtcaatggtatctttcaggaacgcttcgtagttctggcccaaagtgataatcagacacagaatgaatgcgaagatcggccccagtgggaagaaacctgaacggtacggcagatcgttaatgtcgtgtccctgcaatacgtaaccgcgacggaagcgatagtggctaatggcaatccccagccaggcgataaaacccgtcatcccggaggtgttcagcagccacaggtataccgtctggttgccaaacatggaggtcaggaagcacaaaccggcaatcaccgtcgtcgcatacagcgcattacgcggcacgccaccacgcgacagtttagcgaaaatgcgcggcgctttaccgtcacacgccagggtatacagcatacgagtagacgcatacataccggagttacctgctgacagcaccgccgtcagaataactgcgttcatcaccgccgccgcagagagcagacccgcgtgctggaacaccagggtgaacggactgacgctgatgtctttaacatcgttacgcagcaggctcggatcggtatacggaataatcaggctgataatcaggatcgcgaacacatagaacaacaggattcgccagaatacctgacgtaccgcgcgtggaatgtttttcgccggatcttcggactcgcctgcagcaataccgatcagctcggttccctggaaagagaagccgacaatcatagctacgccgatcatcgccgcaaaaccaccagcaaacggcgcttcgccgattgtccagttgctccagcctgcaggctgcgcgcctttgaagataccgataatcatcagcacgccaacgatgataaagacaataactgtcgtgactttgatcagtgagaaccagtattccgcttcaccaaagccgcgaacagagatgtagttcaacaggaagataacgccgaggaacaacgcactccagatccagcccggtgtatccgggaaccaccagctcatgaccagctgtgctgcaaccaggtcaacggcaatagtcaccgcccagttgtaccagtagttccagcccagcgcgaagccaaagccttcttcaacatagttctgaccgtaagtggcaaacgaaccggaaaccggcatatatgcagccagttcaccgagactggtcatcaggaagtaaaccatcaggccaatcagcatatacgagagcaatgccccgcccggacctgcctgagaaatcgttgcgccagaggcaacaaaaagacctgtaccgatggaaccgccaatggcaatcatcgtcaggtgacgcgccttcaattcacggcgtaagcccggcgcttctgtagttttagtttcggaacccatacaaaaatgctatccatcttaaaaatgaggcgcgattgtagcagacgattggcaatccttccggcagaaatacatggttataagacaccttcatgatcgcccagggattataagtaaagcagccaatctcttttctggcgaatgcatgctgagggcgctgcgtcacgaaatcgacacagcaccagcatgttcttgtacagcaccttaacgcggtacattcgcgggatcgcaatagtccagaaagcgccgtagcgcgttggaaaggtgtttttgccgatgatgtatacgccacaacgtacgcatcaggcgcggcagagggaccgcaacttcacttaatgtgcctgcctgcaattgatcttcaatcacccgtcgcgacagacaactaattcccaacccatgacgcaccgcatgtttgattgcctcggagttacctaattccatcgccatctcaaacttcggtaaatgtgacagcaacagataatcgacaatctcccgcgtgccggaaccgcgttcacgcaggatccacggcgcagcggccagctgttctaaggtgaccggaccacgagccaacggcgaagtcggcgcggcgaaaaccaccagctcgtcttccagccacggttcagaaatgatttcagtgctgtggcacggtccttcaataaagccaatatcaacgcggaaatccagcaccgcttgcatcacgtcctggctattcccaacgctaagttcaatcggcaactgcggataatcatggcgataacgggcgataactgcaggcagaatgtagttaccgatggtactactggcatagatacgaatcgcgccgttgtcttcgcgaaacagttgttcgatttcaaccgcctgttcaagcagtgccaacgctcgcggatagagcagccgcccgtgttcattaacaaccagtcttttccccacgcgatcaaacagttgaacgccaagctgcccttccaggtcggtcaaggctgcgctcactgctgattgcgacaacgccagcatcaccgacgcctgggtggttgatccacttttcaatacttctgcaaaaacttccaactgccggagggtgatgtgcatagtcgcttaccacttataaagattaattataaatatataatcaattttatttttaaaccagttagtcgtaaccttatgcccggttaaaggagagggttatgacgaatatcaccttacagaaacaacatcgtacactgtggcattttattccggggttagccctgagtgcagttatcaccggggtcgccctgtggggtggttccattcccgcggttgcgggtgccgggtttagtgccctcaccctcgcaatcttgttggggatggttttaggcaacaccatttacccgcacatctggaaaagctgtgacggtggtgtgctgtttgccaagcaatatttattacgtctgggtatcattctttatggcttccgtctgacgttctcgcaaattgccgatgtcggtatcagtgggatcatcattgacgtgttgacgctgtccagtaccttcctgctggcttgcttcctggggcagaaagtgtttggtctggataagcacaccagctggttgatcggtgccggtagcagtatctgtggtgctgccgcggtactggcgactgagccggtagtaaaagcagaagccagtaaagtaaccgtggctgttgcaaccgttgttatcttcgggaccgtcgcgattttcctctacccggcgatatatccgctgatgtctcaatggtttagtccggaaactttcggtatctacattggttctactgtgcacgaagtggcgcaggtggtggcggcaggtcatgccatcagcccggatgcagaaaacgcagcagttatttccaaaatgctgcgcgtgatgatgctggctccgttcctcatcctgctggcggcgcgtgttaaacagctgtctggggcgaacagcggcgagaaaagcaaaatcactattccgtggtttgccatcttgttcatcgtcgttgccatctttaactcgttccacctgttaccgcagagcgtggtgaacatgctggtaacgctggataccttcctgctggcaatggcgatggcggcgctgggtctgaccactcacgtcagcgcgctgaaaaaagccggggcgaaacctctgctgatggcactggtactgtttgcctggctgattgttggtggtggtgcgattaactatgtgattcaaagcgtcatcgcataaaccactacatcttgctcctgttaacccgctatcattaccgttttcctccagcgggtttaacaggagtcctcgcatgaaatacattggagcgcacgttagtgctgctggcggtctggcaaatgccgcaattcgcgccgccgaaatcgacgcaaccgcgtttgccttgttcaccaaaaaccaacgtcagtggcgtgccgcaccgctcacgacgcaaaccatcgataaattcaaagccgcctgtgaaaaatatcactacacatcggcgcaaattcttccccacgacagttatctgattaacctcggacatccggttgctgaagctctggaaaaatcgcgcgatgcctttatagatgaaatgcagcgttgcgaacagctggggctttctttgctcaacttccaccctggcagccatctgatgcagatttcagaagaggattgccttgcgcgtattgccgaatccatcaacattgcgctggataaaactcaaggtgtcaccgcggtgattgaaaacagcgccggtcagggcagtaacttagggtttaaattcgaacatctcgcagcgattatcgacggcgtggaagataaatcccgcgtcggcgtctgcattgatacctgccatgctttcgctgccgggtatgatttgcgtactcctgccgaatgcgagaaaacgttcgctgattttgcccgtattgttggctttaagtatctgcgcgggatgcacctcaacgatgcgaaaagcacctttggcagccgcgttgaccgccatcatagcctcggcgaaggcaatatcggtcatgatgcgttccgctggatcatgcaagacgaccgtttcgacggcattccgctgatccttgaaaccatcaacccggatatctgggcagaagagatcgcttggctgaaagcgcaacaaactgaaaaagcggtggcctgatcgatgaacgacagggaaaagcagattcttaaaattttacggcgtaacccgctgattcaacagaatgaaatcgccgatattctgcaaatcagccgctcacgtgttgccgctcatattatggatttgatgcgcaagggtttgattaaaggcaaaggatatatccttaccgagcaggattactgtgtggttgtgggtgcaatcaatatggatattcgcggaatggcggatatccgttacccgcaagcagcctctcatccaggttctgttcactgttccgcaggcggcgtcggacgtaatatcgcgcataacctggctctgcttggtcgggatgtgcatttaatttcagctattggcaacgatttttacggcgagacattactggaagaaacgcgccgcgcgggcgtgaacgtttcaaactgcattcgtctgcatggacacagcacagcaacttatctcgctatcgctaataagcaggaagaaactatcctggcaatcaatgacacacatattctgcaacagctaacgcctcaactgctcaatacttcacgggacttgattcgccatgctggtgtggtgctggctgattgtaatctcacacctgaagccctggagtgggtctttaccattgctgatgaaattccgatgtttgtcgataccgtttccgaatttaaagcgaacaaagtaaaaaactggtacagccggatccacactctgaaaccgacacaaaatgaactggaaattttgtgggggcaaccgattaaagacgacaacgatcgcatcagagctgtaaattcgctgcatcaacaaggtgttaaacgcatttttgtttatctgaaagatgaatctgtattttgcagcgataaggatggagaacaatttttgctgaccgcgccagcgcatacgacagtagacagttttggtgctgacgatggttttatggcgggcctggtatatagctttcttgaaggatacagtttccgcgacagcgcccgttttgcgatggcctgcgcggcaatttcacgcgccagcggcagcttaaacaaccctaccctgtctgccgataacgcgctttcattagtgccaatggtgtaacaatgttgccggattcgacgcttgaccgcatcttatccggctcataaattgcgcactacgctaaaccaataaagaatcctgcaatagtagcactcaccaggttactgacagcaaaaacgcaatagccagtaataccaccattcccagaacacttctcatgacatccatagttattatctcttcatgtcattttgggcgacggctctctgcccatcataacaagccgggcctgcatcttgcgatactgccccggcttgttatcaacacttaatgggtttttatgtagccgcgtacgcactcttcgactaatccccagaaccagtcggtatcaatagtgatgccgactttggtattggcgggcttgccaagaacacccagctcgtcgcagacggtacgcccatagcaagggccactgttaacgtccacttcgacgtacatctcctgggttttaatgccatcagggttaatcaaataaccgatgcaggtggcgtcgtgcaccgggccgccagccaggccgtagttttcgaactgcgttttgagagtgaagttcatgatgtcgctgaacagctctccggcagggccgccagccctttccatccgagcaatcacatccggggtgcaaacggtctggttggtaagatcgaggcccatcatcactaatggaacgccggaggtgaacaccacgcgtgcggcctccgggtcagcaaagatgttgaactcagcagatggggtgaagttgccagtaccataagcaccgcccatcagaacaatttcacggattttcggcaggatcgcgggttgcatacgcattgccaccgcgatgtttgacaacggaccaaccggcaccagagtgatatcgccatcgcttgccataagggtatcgatgatatatttcaccgcatgagtgttttctgcctggcgggtcagcggctcgaataccgggccatccagtccggtttcaccgtgaatattatcggcaacaatttgttgacgcataatgggctgcggcatccccgcataaaccggaacattaatctccagtttctggcaaacattcaggccattaattaatgttttatcgagggtttgattacccgctacaatggtgatacctaataaatcaatcgccggatgtttcgccgccatcattatagcaatagcatcatcatgacccggatcacaatccagaataatttttctcttttccattgtttatttcctctgtttccagttgcgttattgtttctacagcaaagaaaattcgacctggccgatgattgaatcttaacaacagcgtacgtatgctaaatatgagaaatctcatagcggataaacatcgtgaaagaaatccacaataatgatcttaagcagcaattgatgagtgaatctgcgtttaaggattgcttttcaacggatgtttcagccgatacgcggctgtttcattttttagcgcgtgactacattgtgcaggaagggcaacagccgtcctggctgttttacctgacgcgaggccgcgccaggctttacgtcacgcttgctaatggtcgcgtgtcgctaatcgatttctttgccgcgccctgttttattggcgagattgagttaatcgacaaagaccatgaaccgcgtgcagtgcaggctattgaagagtgttggtgccttgcgctccctatgaagcattaccgcccgttgttattaaacgacacgctatttttacgaaaactctgcgtcaccttaagtcataaaaattatcgtaatattgtttctttaactcagaatcaatcatttccgttagtgaatcgcctggcagcttttatattactctcgcaggaaggtgatctttatcacgaaaagcatacgcaagcggcagagtatttaggcgtttcttatcgacatcttttatatgttcttgcgcaattcattaatgacggtttattaattaaaagcaagaaagggtatctcattaaaaacagaaagcagttgtcaggactggcgctggagatggacccggagaataaattctccgggatgatgcagtaaaaattattggcaatagtgcgattgccggatgcaacgcttaataaggcgtacatccggcaatgaaactcaagctaaaccaataaagaacccggcaatggtcgcgctcatcaggttggaaagcgtcgccgccgccagcgcccgtaaaccaagctgggcgatttccggcgcgcgttttggcgaaatagccgaaaacgctccaacgacaacaccgatagaaccaaagtttgcaaacccacagagggcgaacgagataatggcaatggtcttgacatccagcgtgccgctcgtttgcagatagggcgagaaattgagataagcaacaaactcattaatcgccagtttctgcccaatcaaacttccggcaagatttgcatcactccagtccacccccataatccatgccaacggggccagcacatagccgaaaatgctttccagagagacattggcaaaaccaaaccagccgccaactccaccaataatgccgttgatcagcgcaatgatcgccacaaatgccattaccaccgtcgccacaccggcggcgattttcagcccagtcattgcaccgttcgccgcagcttcaataatgctttttggcggtgtttcgctaaacgacagattttcaaacgtaacttgcgaaggttccgtcgccggactaagaatacgtgcaaacaggataccgccaggaatagccatcagcgaagcggctaacaaatagtcaatcggcacgcccattccggcatagccaatcatcatcgaacccgcaatagacgccatgccgctacaaatagccgtaaatagctcgttgcgattcatgcgatcaataaaaggtttcacgatcgccgggatctcattttgcccgaggaaaatagtggtgactgcgacaaaagattcgattttgctgatgttgagggctttctgaaaaatactgccaagaatacgaatcagcagccccattacgccaatgtagtacagcaagctgataagcgcggtaacgaaaataatcgccgggagtacgcgaaaggcgaagataaagcccgcaccgtcaaacagaacatccattttgggaccgaccagcgaaccaaaaataaaggcacttcctgcgtcactgtaggacatcactttatggacgcctaatgccgcctgctctactgcccattttcccgggggaaaatagagcatgatgccaccaatggcaatttgcagcagcagcgcagccccaaccgtgcgcaagctgatgctctttttatttaccgacaacagaaatgctattgccagtaacaccaccatccccacaacacttctcattatatccataatgattttcccttcatgccagtaaacccggcgtcagcgccaggttttggtatgtttgatgagtacgggcgacggctttctgcccaccagaaattaacccacgagacgctgatattctttggcaatttcgctcgccagaatggcgttattaaagaccagttgaatattggatttcaggctatcaccgccggttagctccgcaacacgcgccagcaggaacggtgtactctctttcccaataacaccctgttcttcggcttcagcaacggcttgatcaattgctgcattgatggtttcttctggcatcgcaaactgttccgggatcgggttcgctaccaccaggccgccgttcaaaccggtttgccacttcactgccatcgcgcgagcaatttcgcgggcactgtcgagacgaatgctgacatcaaatgggctggttcggcagaaaaacgcaggcagcgcttttgtctgataaccaattaacggtacaccgaaggtttctaaatattctgttgttaatcctaaatcgagaatagattttgcccccgcacaaacaacagtgacattggtatttgccagttcctgtaaatcggcagaaatatcgaaggtatgttccgctccgcgatgcacaccaccaatacctccggttgcaaaaactttaatcccagccagtgctgcaataatcatggttgatgcaacagtagtcgcgccatttttccctgcagcaacgacaaaaggtaaatcacgacgactaactttcgtcacgttatgtccttcacggcccagcaattcgatttcttctttacttaagcccactttcatcacaccgccaataatggcgatagtggctggtactgcgccctgtttacgaattgtttcttctacttcaattgcggtttgggcattttgtgggaatggcattccgtgagaaattatggtcgattccagcgcaacaaccggttttttattttttaaagcatcctgtacttcagcggatatttgtaataattcaggggacagagttaattcagacattctgtgttctccactaacgatgtaacattggcaattgataattcagggttgttggtatattcacaggcaagtgccattgacgaacatccctgcgcaaatcgaacagaatcgataaacggcataccgtctacccaacaggaggccagccccgccatcatggcgtcgcctgccccagtaacattgatgacattagttttaataggggccgaccacccactttcaccgttgatatcactgtagtaaacgccatcccctcccatgctcagcaccaggcggttcaggccgtgttgatgaaaccaggcggcgacctttgcgacatcttcacgtccggaaagtgcaattccgctcaacgtttcggcttcaagacggttaggttttaacgtatggattttgctcagatgatcgcggattttgacgcatttccatgccgataccggatcaataaatacaggcgtttccccgctattttccagaacccagaccagcgcctcttcactaaggttgcaatccgcgacaataacctttgcaccgcgaataaactcctgatgctgggcaagaaattctgcagaaatacagtcactaatactcatatcatttatcgcgacaagcatttctcctgtattatcgagcagtgataaatagctggatgtattctcacccggaacaattaagcatttatcgacataaacaccggattgattagtttgcgccagtaatgattgcccataaaaatcaccacctactgcacttaaaagccaggcatttttccccagtaacgccagattatgagcgatattccttcccacgccacctggggtaaatttaatttttccgggattcgaatccgcataattcaatggatgatgtgaatacccagccacatcaatattcgccgagccaataattactatgtagtccttttcgcgcatagcacgccccctggcaataaattgccaacgaagaaattgggtaaaatagtcattacagtcaataagactattagaacacgtgttcagatttaaacacatgttcataataagcatgtttaacgcaatgtaaatcgatcagaaaaaacgaaatcggccagatatgaaggcggtcacaaaatttgtctatttatgcagcaacaaaagagaaagttgtgatgtgtaacacacaatatggcaggcaagaaaaagggcagagatgtttctgccctcagattgttgacaacgcgcgctttgttcatgctggatgtggcgtaaacgccttatccgacctacaaaagcgcaaaaattcaatatattgcagggttcatgtaggtctgataagcatagcgcatcaggcaattttgcgtttgtcatcatcggggcagagatgtctcagccccgatgatgaagagaaattatgcgtttttttctactatttgtgtttccgggcgtttgaggaaggcataggccaaacccgccaccagcgtaccggcaataattgctaccaggtaacccaataccggcgtaatagcgccagggatcagcagaacaaacagaccaccgtgtggtgccatcagtttcgcaccaatcgccattgagattgcgccagtcagcgccccaccaacgatacagcacggtagcacacgcatcggatcacgagcagcaaacggaattgcaccttccgaaataaagcacagaccaagtaccagagcggctttgccaccttcctgctgcgctttgtcgaatttgcgacgcgccaccattgttgccagacccattgccagcggtggcaccatacctgccgccataatcgccgccatcgggccataggtttgagtactcagcagacccacaccgaatgcgtacgctgctttgtttaccggaccgcccatgtcagtacacatcatgccaccgaggatcgcccccagcagaaccgcattcgcagtccccatggtctgcagccagtgagtcaacccatcgagaatgccagcaaccggtttaccgattaggtagatcatcgccagaccgaccaccagactggaaattagcggaatgatcaggatcggtttcagtgcctccatactctgtggcagtttcagttgcgtactgattaacttcgcaatgtaacccgccaggaagcccgcaataataccaccaatgaagccagaaccggtgctaaccgccagcataccgccaatcagacccggcgtgagacccggacgatcggcaatggagaaggcaatataacctgccagtaccggcaccatcagcgcaaaggctgaaccaccaccaatctgcatcagcgccgctgccaacgtacccggctctttaaacgcttcgataccaaaagcaaaagaaagcgcgatacacagaccacctgcaacaaccatcggcagcatgtaagagacgcccgtcagcaagtgacggtaagcgcctgcactctctttcttaccttcagtggtcgctgtttgagttttgcccgccggttcatacggcgttgcttcagcaacccctttatccagttcctgcgcagttttcttcagcgccagaccggtagaggtgcgatacatcggtttaccagcaaatttcgccagatccacttcgatatctgccgccacaatcaccagatccgctgctgcgacttcttcaggggtgattgcattacccgcgccaacagaaccacgggtttcaactttcacccaccagccacgttttttcgcttcggtttcaatggcttcagccgccataaaggtgtgtgctacgccagtcgggcaagcagtcaccgcaactacgcgtttcggaccgctggcggcaaccggtgctgtcgcagcgaccggcgcagtgtaaggtttcgcatggcctttggcttcactcaggaacagctcagggtgcgcaactgcccgggaaatatcgcccagccagacatttttaccgttcagcgcgctgtcattcgggatggaatcaccgagaacaatcgccatttctgcgtcgttcggattgtcgatgatttccagttttgcttttcgcgccgccgcgcccagcagggtcttcgccatataggcgcgtgcctgaccgagattagcgtcaataatcagcagcgttttcattatgcctctcctgctgtcagttaaaaggttgtaagtcgacgcgcgccatcattgcggccaactgcggacgatcggtaatacccacattgctttgacttaccgccagggctgcaacagctgtcgccagacgcagtgtgtgttcactggattcacgcatcagcaagccataaatcaggccaccaaccatagaatcccctgcgccaacggtgcttacgacatcgactgacggtggtttggcgatccattcgccggaggcattaacccaaagcgcgccttcggcacccagtgaaataacaacatgcgcgatgccttgttcacgcagcgcatgcgcagcttcaatcacatctttcatttcaggcagtttacggcctgcccagatttccagctcgcggcggttaggtttcaccagccacggtgccgctttcaaacctgctactaacgcttcacggctactatcaaagataatgcaaggacactgactacgcaggcgagtcatccagtcggtgaacgcttccgggctgacgcctgacggtaagcttccgctgacacagaccatatcgaactgaccgagccagctcagagaatcagtcacaaagcgttcccagtcggcgggggtgacttcaaaacccgagaagttgaagtcggtcacttcgccgtctttttccgtcagcttaacgttaattcgggtgcgcccctgtacaacctggaaacggttggcaatgcccagctcgctgaacagttgctgaaaaccatcctgattgtctttacccaggaagccgccaacggtgacatcaattcccaggtcttttaatactttggccacgttgatgcctttacccgccgcatgcagaccggtggttttcaccaggttcacttcgccgcgttcaatttccgggcagaaaccaacaaggtcataagccggattaagggtgatcgtagcaacacgtctactcattatgcgccctccccaagaccagcagcgatagcgtcgccaatggctttcagcgcctgttcagcatctgcaccctgggcggtaaagcgtaggcgatgacctttcttaacgccaagtgccacaactttcatcagactacgtccgtttgccggtttgccggtgccatcaaggtttgtcacggtaatatcactgttaaattgtttaatggtattgaccagcatggtacctggacgagcatgcaggccgtgttcattgcgcaccacaaactccgcgcttaacacgtcgtcggtcggcgcatcatcgctggtcagcagcgccagcaacgttgccgcatccgctttcagcaagcggtcagctttattatcgagcaacaaatcagcgagacgcttaagaaccgcgatgggctgatcgtcattcatcgccacactcaccagcatggctgccgtttcgccgtccacatcaaaagcatttgccgcacggcttaccgcaatcgcgctacgcagattgccttcggcgctatcgctcagccagataccctgcccgaggttcagcggttgttcattgatggctttggtgacgaaagtggcgtcaactgcccccgcctctttcagacgcgcagcgttcagcgcctgaagagtcagcagatcgctggcgacgatatccaacgtcagcatttcgttgtcgagcttcagctgctcactctgcttttcgcccatcagcaatgcgcgaagttcttctgctgttgttgctgacttcagttgttcagcaacggaatcatcgctcagtacgtgggtcagctggcgtagcaggcccaaatgttcatccgagctggcagcaataccgatcgccacgtacgctacctggccgtcaccccaggtgacgccttccgggaactgaaatacctgaacgccggttttcagcacctgatcgcgggtgtcggtagtgccgtgtggaatagcaataccattgccgaggaacgttgaggtttgctgttcgcgcgccagcatgccattgacgtagccttcagctacattaccggcctgcaccagcgccgcagcgacctggcgaatcgcctcttctttgtctccggccttttcgcccggatggatgtcctgtacggataactggaacatagttctcctctcttgctgaattgaaacgattcagcttctatgaaaaaaaaagcgccaacctggcttagggttaaagacaagatcgcgctgaaacgtttcaagaaagcataatacttttgtttcagcacgcaaggaaagccgtaaagttatgagcaaaagtttgatgtgctgcacaattttttgtcatttttcctaattgctgatgggaaaatccgttatcagcaatttcatttcagcagcgtcagcagccaatcagcaacagtgaaatggcattttgattattcgtggcgcttttgatttcgctgtctgtttattttctgacaagcagcgtaaactccgcgtcttcctcttccagtgatcgaccagcatgcataactcccccgcagtcaccagcgcgaaatcgtttgacctgacctcgatggcgtttttaatcgttgcctttctcaccggtattgcgggcgctctgcaaaccccgacactcagtatttttcttactgatgaagtacatgcccgtccggcgatggtgggattcttctttaccggcagcgcaatcattgggattctggtgagtcagtttctcgccgggcgctctgataagcgcggcgatcgcaaatcgctgattgtcttttgctgcctgttaggcgtgctggcctgcaccctttttgcctagaatcgcaactactttgttttgctattcgttggcgtctttcttagcagctttggctcaaccgctaacccgcaaatgtttgcccttgcccgtgaacatgctgacaaaaccggacgtgaggcggtgatgttcagctcttttttacgcgctcaggtttcactggcatgggtcattggcccaccgctggcttatgccttagcgatgggtttcagctttacggtaatgtatctgagcgcagcggtagcgtttattgtttgcggcgtgatggtgtggctgtttttgccgtcgatgcaaaaagagcttccgcttgcgaccggcacggttgaagcgccgcgccgtaaccgtcgcgatacgttgctgctgtttgtcatttgtacattgatgtggggctcgaacagcctgtacatcatcaacatgccgctatttattatcaacgaactgcatcttcccgagaaactggccggtgtgatgatggggaccgccgcagggctggaaatcccgaccatgttgatcgccggatattttgccaaacgtctgggtaagcgcttcttaatgcgcgttgctgccgtgggtggcgtctgtttttacgcaggaatgctgatggcgcattcacctgtcattctgttgggcttgcagctgctaaatgctatttttattggcattctgggcggcatcgggatgctctattttcaggatttgatgcccggtcaggcaggttcagccaccacgctctataccaacacgtcgcgcgtgggctggatcatcgcaggatcagtggcgggcatcgtcgccgagatctggaattatcacgctgtgttctggtttgcgatggtgatgattatcgccactctgttttgcttactgcgaattaaagatgtttaaggcgcggtcaacatttccagatcgataagccaggtcattgcctgctgacgcgagttaccgcacatttcagcgctggcttgtaagcctgcacagactttcggtcgcagtggcgaggtgaaaattttacagcgttgctgttcatcaagctgaatgcagggcgtattggcgggcttgccatctggcataccgggaatagggctggaaattgaaggggcagtgcaacacgccccgcaacccggacggcattccatacgttgttctcttaaggttaaccaccggattgatgagcgcgcacagtaccaccttttttgcaccagcaaaagtgcgaataccacttgcccgaaaggcccgtcgcgagtactttgtcgcgatatttttgacatttttgactacaggaatttttcgatgccaagagcgaacgaaattaaaaaaggtatggtactgaattacaacggcaaactgctgctggttaaggacattgatattcagtcgcccactgcccgcggtgccgctacgctgtacaaaatgcgtttttctgatgtccgtaccgggctgaaagtagaagagcgtttcaaaggtgatgatatcgttgacaccgtgacgctgacccgccgttacgttgacttctcctatgtcgatggcaacgaatatgtctttatggataaagaagactataccccgtataccttcaccaaagatcagattgaagaagagttgctgtttatgccagagggcggcatgccggacatgcaggtgctgacctgggatggtcaactgctggcgcttgagctgccgcagaccgttgatctggaaatcgttgaaactgcaccaggcatcaaaggggcatctgccagcgcccgtaacaaaccggcgacattgagcactggtctggtgattcaggtaccagaatacttaagcccgggcgaaaaaattcgtatccatatcgaagaacgccgttatatgggtcgtgctgactaacttcagccacatgcagaaaagggatagctcaggctgtcccttttttaatttattataccaatcttctattttgcgcttcctgaacaccttacgcccgcaattttcactcgttgattgatcgccctcacacttcatcgcattaacaatccagaccaatttcaattgctgtcatataactttacactgtcattgttaattaatcgttactaagacgtgactcctatgaatacaatcgcctccgttacgctcccgcatcatgtacacgctccacgctacgatcgacagcagttgcaatcacgtatcgttcattttggctttggagcctttcaccgcgcacatcaggcattactgaccgatcgtgtgctgaatgcccagggcggcgactgggggatctgtgaaatcagcttgttcagcggcgatcaactgatgagccaactccgcgcacagaaccatttatataccgtgctggagaaaggtgcggacggcaatcaggcgataattgtcggtgccgttcacgaatgtctgaatgcaaaactggattccttagcggcaattattgagaaattttgcgagccacaggtggcaattgtttccctgacgattaccgaaaaaggctattgtattgacccggccaccggtgcactcgacaccagcaatccgcgtattattcacgatctacaaaaccctgaagaacctcactccgcgccaggtattctcgtcgaagcactgaaacgccgccgtgagcgcggccttacaccgtttaccgtgctctcctgcgacaatattcccgacaatggccatgtggtgaaaaacgcggtgctgggaatggcagaaaaacgttcgccagaactcgccgggtggataaaagaacacgtcagttttccgggaactatggtcgaccgcattgttccggctgcaacaaacgaatcactggcggaaatcagccagcatctgggggtgaatgatccctgcgcgattagctgcgaaccgtttatccagtgggtggttgaagataacttcgtcgctgggcgtcctgcctgggaagtcgcaggtgtacaaatggtgaatgatgtcctgccatgggaagagatgaaactgcggatgcttaatggcagccactcttttctcgcttatctgggttacctctcaggattcgcccatatcagtgattgcatgcaggatcgcgcatttcgccatgctgccagaacattaatgctggatgagcaagcgccgacactgcggattaaagatgtcgatttaacacaatatgcggataagttaattgcacgttttgctaatccggcactgaaacataagacctggcaaatcgcgatggatggcagccagaaattaccgcaacgcatgttggcaggtattcgcatacatctggggcgcgaaacggactggtcgttgctggcattaggcgttgcaggctggatgcgttacgtcagcggcgttgatgatgccggaaatgccattgatgttcgcgatccgcttagcgataaaattcgtgaacttgttgcggtcagcagcagtgaacaacgcgtaaccgccctgctttccctgcgtgaaattttcggtgatgatctgccagataacccgcattttgtgcaggccatcgaacaagcctggcaacaaatcgcacaattcggcgcgcatcaggcgctattaaacaccctcaaaatttaacgatttctgcggttaaagcggatgaagctcgccttcgtccgctctccccttctcttttctgccttttttagccaggattaacgctcagttaacttaccagagtattgcggagccgttgtgaccagaaccaacctcatcaccggttttctcggcagtgggaaaactacgtcgattcttcatctgttagcccataaagatcccaacgaaaaatgggcggtactggttaatgaatttggggaagtcggaattgatggtgctttgctcgccgatagcggcgcactgttgaaagagatccccggcggctgcatgtgctgcgttaatggtttacccatgcaggtagggttgaataccttactgcgtcagggaaaaccagaccgcttgttgatagagccgaccgggctgggccatccgaaacagatcctcgatctcttaaccgcacccgtctatgaaccgtggatagatctgcgcgccacgttgtgcattctcgatccacgcctgctgctggacgaaaaaagcgccagcaatgaaaacttccgtgaccagctggctgccgcagacattattgtcgccaataaatccgaccgtgcgacgcccgaaagtgagcaagcgctagagcgctggtggcagcaaaatggtggcgatcggcaattaattcacagcgagcatggaaaaattgacggtcatcttctggatttgccgcgtcgcaatttagccgagttgcccaccagcgccgcgcattctcatcagcatagcgtgaaaaaagggttagcagcgttaagcctgccagagcatcaacgctggcgtcgcagtctgaacagcggacaagggcatcaggcctgtggctggatattcgacgctgatacggtattcgacaccattggtattctggaatgggcgcgacttgcaccggtggaacgcgtcaaaggcgtgctgcgtattcccgaagggctggtgcgaatcaaccgtcagggcgatgacctgcacattgaaacgcaaaacgttgcgccaccggacagtcgtattgagctgatttccagcagcgaagctgactggaatgccttgcagagcgcgctgttgaagcttcgtttagcgactaccgcgtaaggttgcctgcatttttcagtaagataattagagaaaatatgattaaaaatttgccgcaaatagtgttgttgaatattgtcggcctcgcgctgtttctttcctggtatattcccattaatcatggattctggttgccgattgatgcggatattttttatttctttaatcagaaactggtcgaaagtaaggcctttttatggctggttgcattgaccaacaatcgcgctttcgacggttgttcactgctggcgatgggaatgttgatgctgagtttctggctgaaagaaaacgccccaggcagacgacgtatcgtgattattggtctggtcatgctattaactgcagtggtattaaaccagctgggtcaggcattaattcctgtaaaacgggccagcccaacgttgacttttacccatattaaccgcgtcagcgaactgctctctgttcccacgaaagatgcctcacgagatagctttcccggcgatcacggtatgatgctgcttattttttcggcattcatgtggcgttatttcggcaaagttgcaggccttatcgcccttattatttttgtggtttttgcgtttcccagagtaatgattggcgcacactggtttactgacatcatcgtcggttccatgaccgtgatattgatcggcttgccctgggtgttgctgacgccattaagtgatcgattaatcaccttttttgacaaatcactacctggaaaaaacaaacatttccaaaacaaataactcacagtaattaacatcatcaggtttatttttatagtgaggataatcctgatgatgcgcctcctgctttcatccatcgagcgcaaaaatcattctctaagtaaatgaatggattgcatgcgtttcactcaatcgtactttaattgaccaatcccgctgattaactttctgtatcactttttcttataaaaaatcatgtaaaaccgctcgccaagaccgcaccaatcgggtaatctcgaactcgttttgcctcggcggtagattatcctcacagcatataattttgtgcgttagtccacagatttggccttaaggaattgtttcaacatgcccaggtaattagtctcgtgtcgcttggcatttttttataacgatatttgtcgttaaggacttcaagggaaaacaaacaacatggtcaaatctcaaccgattttgagatatatcttgcgcgggatacccgcgattgcagtagcggttctgctttctgcatgtagtgcaaataacaccgcaaagaatatgcatcctgagacacgtgcagtgggtagtgaaacatcatcactgcaagcttctcaggatgaatttgaaaacctggttcgtaatgtcgacgtaaaatcgcgaattatggatcagtatgctgactggaaaggcgtacgctatcgtctgggcggcagcactaaaaaaggtatcgattgttctggtttcgtacagcgtacattccgtgagcaatttggcttagaacttccgcgttcgacttatgaacagcaggaaatgggtaaatctgtttcccgcagtaatttgcgcacgggtgatttagttctgttccgtgccggttcaacgggacgccatgtcggtatttatatcggcaacaaccagtttgtccatgcttccaccagcagtggtgttattatttccagcatgaatgaaccatactggaagaagcgttacaacgaagcacgccgggttctcagccgcagctaataaaccgtttggatgcaatcccttggctatcctgacgagttaactgaaagcactgcttaggcagtgcttttttgttttcattcatcagagaaaatgatgtttccgcgtcttgatccaggctatagtccggtcattgttatcttttaaatgttgtcgtaatttcaggaaattaacggaatcatgtttatacgcgctcccaattctggacgtaagctcctgcttacctgcattgttgcaggcgtgatgattgcgatactggtgagctgccttcagtttttagtggcctggcataagcacgaagtcaaatacgacacactgattaccgacgtacaaaagtatctcgatacctattttgccgaccttaaatccactactgaccggctccagccgctgaccttagatacctgccagcaggctaaccccgaactgaccgcccgcgcggcgtttagcatgaatgttcgtacgtttgtgctggtaaaagataaaaaaacattctgttcatctgcaactggtgagatggacattccactcaatgaattgattccggcgctcgacattaataaaaacgtcgatatggcgatcttacccggcacgccgatggtgccgaacaaacccgcaatcgtcatctggtatcgcaaccctttgctgaaaaatagcggcgtgtttgccgctctgaatctcaacctgacgccttcactcttttatagttcacggcaggaagattacgatggcctcgccctcattattggtaatactgcgctatctaccttttcttcacgtttgatgaacgttaatgaattaaccgacatgccggtccgtgaaactaaaattgcgggcattcctctgactgttcggctttatgcagatgactggacatggaacgatgtgtggtacgcatttttactgggtggcatgagtggaactttcgttggacttctctgctattacctgatgagtgtgcgtatgcgcccaggcagagaaatcatgaccgccatcaagcgcgaacaattttacgtggtgtatcaaccggtggttgatacacaagctttgcgggtaacgggcctggaagtactgctacgctggcggcatccagtagcaggtgaaatccccccggatgccttcattaactttgccgaagcgcaaaagatgattgtgccactgactcagcacctgtttgagttgattgcccgcgatgccgcagaattagaaaaagtactgccggtaggcgtcaaatttggcattaacattgcgccggcccacttgcacagcgaaagctttaaagcggatatccagaaactgctcacttccctgcccgcacaccatttccagattgtgctggaaattaccgagcgcgatatgctgaaagagcgagaagccacacaactcttcgcctggctgcattcggtcggcgtagaaattgctattgatgacttcggcaccgggcacagcgcgcttatctatcttgagcgttttacgctcgattatctgaaaattgatcgtggatttatcaacgccatcggtacggaaacgatcacttcacccgtacttgacgcggtgctgacgctggcgaaacgtctcaatatgctgacagttgctgaaggggtcgaaacgccagaacaggcacgatggctaagcgaacgcggcgttaatttcatgcaaggctactggattagtcgcccgttaccgctggacgattttgttcgctggctgaagaaaccgtatacgccgcagtggtaaggtgtgcttacgtcccttattattcatagtgaaagcatgccggattgcggctaatgatgagtaaaaggaaatccgttgcagatgattgtgcgcatactgctgctgtttatcgctctgttcacctttggtgcgcaggcgcaggctatcaaggaaagctatgcctttgccgtactgggcgaaccccggtacgcatttaatttcaaccattttgattatgtgaaccccgccgcgccaaaaggtgggcaaataacgttgtctgccctcggcaccttcgataatttcaaccgctatgcactacgcggcaacccgggcgcacgcaccgagcagctgtacgacacgctatttacgacttccgatgacgaaccaggcagttattacccgctgattgctgaaagcgcacgctatgctgacgattattcctgggtggaggtcgctattaatccgcgcgcccgttttcatgatggttcgcccattactgcccgcgatgtagagtttacttttcaaaaatttatgaccgaaggcgtgccgcaatttcgtctggtctacaaaggcaccaccgtcaaagccattgcgccgttaaccgtgcgcattgagttagctaaacccggcaaagaagatatgctgagtctgttttcgctgccggtatttccagaaaagtactggaaagatcacaaacttagcgacccgctcgccacgcctccgcttgccagtggtccgtaccgcattacgtcctggaaaatggggcaaaatattgtctattcccgcgtgaaagattactgggcagcaaacttaccggtaaaccgtggacgctggaatttcgacaccattcgctacgattattacctcgatgataatgtcgcctttgaagcgtttaaaacaggagcctttgatttgcgtatggaaaacgacgccaaaaactgggccacgcgctataccggtaaaaatttcgataaaaaatacatcatcaaagatgagcaaaagaacgaatcagcccaggatacgcgctggctggcgtttaatatccaacgtccggtattcagcgatcgccgggtccgggaagcgatcactctcgcctttgactttgaatggatgaacaaagcgttgttttacaatgcctagagtcgcacgaacagttattttcagaataccgaatatgcggccagaaattaccccgacgccgcggagctggtacttctggcaccaatgaaaaaagatctaccgccagaagtcttcacgcaaatctaccagccgccggtatccaaaggcgatggctacgatcgtgacaacctgttaaaagccgacaaacttctcaacgaagcaggctgggtgttgaagggtcagcaacgcgttaatgtcacaacgggtcagccactcagctttgaattattgcttcccgcaagcagcaatagtcagtgggtattgccgttccagcacagcctgcaacggctgggtatcaacatggacattcgcaaggtggataactcgcaaataaccaaccgcatgcgcagtcgcgactatgacatgatgccgcgcgtatggcgggcgatgccgtggcccagttccgatttacagatttcctggtcatcggaatatatcaattccacttataatgcccccggcgtgcaaagcccggttatcgactcgctgatcaaccaaattattgccgcgcagggaaataaagaaaaattactgccgttgggacgagcactggatcgcgtattaacgtggaattattacatgctgccaatgtggtacatggcggaagaccgtctcgcctggtgggataaattctcccaacccgctgtacgccctgtttacagcctgggtatcgatacctggtggtatgacgttaacaaagcgacgaaactgccgtcagccagacaacagggagagtagatgggcgcttatctgattcgccgtctgttgctggtgatcccaacgctatgggcgattatcactatcaactttttcatcgtgcaaattgcgcctggcggtccggtcgaccaggccatcgccgccattgagtttggcaatgccggagtattacccggcgcaggcggtgaaggtgttcgcgccagccatgcgcaaacgggcgtcggcaatatcagcgacagtaattaccgtggcggacgcggattagatccagaagtgatcgccgagatcactcatcgctacggtttcgataagccgatccacgaacgttacttcaaaatgctctgggactacatccgttttgattttggcgacagcctttttcgcagcgcctcggtgctgacgctgattaaagacagtctgccggtctccatcaccctcggattgtggagcacgctgattatctatctggtgtcgattccgttaggcattcgcaaagctgtttataatgggagccgttttgacgtctggagtagtgcatttatcatcatcggctacgccattccggcctttttgtttgccatcctgctgattgtcttcttcgcgggcggcagctatttcgatctgttccctctgcgcggcctggtttccgctaactttgattcgctgccgtggtatcagaaaatcaccgattatctgtggcatatcacgctgccggtgctggcgacagtgattggcggctttgcggctctgaccatgctgacaaaaaactcattccttgatgaagtgcgtaagcaatacgtggtgacggcacgtgcgaaaggggtaagtgaaaaaaatattctctggaaacatgtgttccgcaacgccatgctgctggtgattgccggttttccggcgacgtttatcagcatgttttttaccggctcgctgctgattgaggtgatgttttcactcaatggcctcggcttactgggctacgaagcgaccgtctcgcgcgattatcctgtaatgtttggtaccttgtatattttcaccctgattggcctgctgctgaatattgtcagtgatatcagctatacgctggtcgatccgcgtatagattttgagggacgttaatgtcgcgactcagccccgtcaatcaggcccgttgggcgcgttttcgccataaccgtcgcggctactggtcgttatggattttcctcgtcttgtttggtttgagtttgtgttctgaacttatcgccaacgataaaccgttgctggtgcgttatgacggcagttggtatttcccgttgttgaaaaactacagcgaaagcgattttggcggcccgctggcaagtcaggctgattatcaggacccgtggctgaaacaacggctggaaaataacggctgggtactgtgggctccgattcgctttggtgctaccagtatcaactttgctaccgataagcccttcccttctccaccctcccggcaaaactggctgggaacggatgccaatggcggcgatgtactggcacgcattctctatggcacgcggatctcagttctgtttggcctgatgctgaccctctgctccagcgtgatgggcgtgctggcgggggcgctacaaggctattacggtggtaaagtcgatctctgggggcaacgttttattgaagtatggtcggggatgccgacgctgtttttgattattttactttccagcgtcgtacagcctaacttctggtggctgctggcaattaccgtcttgtttggctggatgagtctggtcggcgtggtgcgggcggagtttttacgtacccgtaatttcgactacatccgcgcggcgcaggcgcttggcgtcagcgatcgcagtatcatcctgcgtcatatgttgccaaatgccatggtcgctaccctcacttttttaccgtttattttatgtagttcgataaccaccctgacctcactcgatttcctcggcttcggtctgccgctcggttcaccatcactcggcgaactcctgttacaagggaaaaataacctttaggccccgtggcttgggatcaccgccttcttatcggtggcgatattgttgtctttgttgatctttattggtgaagccgtccgcgacgcatttgatcctaataaggcggtgtagcatgacgcaaactctgttagcgattgaaaatttgtcggtgggttttcgccatcagcaaaccgtacgtacagtagtcaatgatgtttcactacagattgcggctggcgaaacgctggcgctggtaggtgagtctggttcaggtaagagcgttaccgcgctgtcaattttacgcctgctcccttgcccgccggttgaatatctctccggcgatattcgttttcatggcgaatcgctgcttcatgccagcgatcaaacgttgcgcggtgtacgcggtaataagatcgccatgatttttcaggagccgatggtgtcgttaaatccattacataccctggaaaaacagctttatgaagtactttcactccaccgcgggatgcgtcgggaagcggctcgtggcgaaattcttaactgccttgatcgcgtcggtatccgccaggtggcaaaacggctgacagattatccgcatcagctctccggcggcgaacgccagcgggtgatgattgcgatggcgctgttaacgcgaccggaattattaattgccgatgaaccaaccaccgcgctggacgtctctgtccaggcgcagattttacagctgttgcgcgaactgcaaggcgagctgaatatgggtatgctgtttattactcataacctcagcattgtcagaaaactggcccaccgcgtggcggtaatgcaaaacggtcgctgtgtcgagaaaaataacgccgctacgctatttgcctcacccactcatccttacacacaaaagctactcaacagtgaaccatctggcgacccggtgccattgccagaacctgcctcaacgttgctagatgttgaacagcttcaggttgccttccccatccgcaaagggattttgaagcgcattgtggatcataatgtggtggtgaaaaacatcagttttacgctacgggcgggtgaaacactgggtttagtgggcgagtctggttccgggaaaagcacgacgggactggcgctgctgcgactgattaactctcagggcagcatcgtctttgacggtaagccactgcaaaatttaaatcgccgccagctgttacctattcgtcatcgcattcaggtggtatttcaggatccaaactcctcgctcaacccacgactcaacgttttgcagattattgaggaaggcttacgggttcaccagccgacgctttctgccgcgcaacgcgaacaacaagtgatagccgtgatgcatgaagtgggattagatcctgaaacacgccaccgttatccagcggagttctctggtggtcagcggcaacgtattgcgattgccagggcattaattcttaagccttcgctgatcatactcgatgaaccaacatcatcgctcgacaaaacggtacaggcgcaaatattgacgctattgaaatcattgcaacaaaagcatcaactggcctatttgtttatcagccacgatttgcacgttgtccgcgcgttatgtcatcaggttatcgtactgcgacaaggggaagtagtggaacaaggaccgtgcgcgcgcgtgtttgccgcaccgcagcaggagtatacgcgtcagctactggcgttgagctgacgcttaaaaaggattgtagtttgagaagggttcggcaattgccacaccaaaatttttcaatcggcatgttgcagcaaactcgtcctggcgatttacaaacaggcacggctcaccttcacactccagtaccgagcatggaacttcaatgtcgcttaacgcctggctgagtttgtacatcaccgaccatgcattatcaccatccgggctaagcaatttaagcgccaccaggctgttgtcaccacacggtccattttgcggaatcggttcaaccttcgaacctgcgaaaccagcagaccagcgatagttctgcggcagtcgatggacgattgagagttgtaatgaagtcacttattttccccggaagcacatttacttcacaatttgtttgcatcaattttaacacatcatcaacaatccgtctttatacagatcgtaaagattgatgcctcgccagcgtggcctctatggctctgatttaaataatatctgcgggcgtggtcacgtttgcggggctatatgtacccgtttctgcgatctaactcaacctttttaactacaatgatgtgactttttacataaattgattttacataaaataaacatatatcgggggaatgatggatttgtggttgacatgcatcaacaaaggaagccttttagcttcctcgttgtgcaatagatcaccgttttttcggccgactggcgtacagacagaagagaatggagctggttgcgcagaatgcaattgaccaaatcatcggccatgcagagttaaaggtcgcaagagaaagtaatgcgccaacaattgcccctatgccgaaacggaaggttcctgccagcgaagatgccgttcccgccatatggggaaactcatcaagaatgaccgccatcgcattggatgacaccatcgacacgcagcccacaaacgccgcaacgccaaccaccagcgaccagaatcccagccccagcagtgcactgatgaccatccacgctgccataataaactgtatccacaaccccgagcggaacatatttaacgcgccaatacggcggacgaagcggctgttaaagatggtcatcacgaacagaaaaagaatgtttagcgcaaagtaataaccaaagttttccggcgcgacgtggttgatttcaatgtagacaaacggtccggcgcttaagaatgagaacatcccggcaaagctgaaaccgctggccagcatataactcaggacacgcttatgacggaacaacgccgcaaagttaccaatagtggtacgaatgtgaaaaggctggcgacgctccggtggtaaggtttctttgatcagaaagaagatcattgccgaagccagaatcgccgccacggcgaggatccagaagatgtaatgccagctcagccacaccagcacccagccgccaactatcggtgccatcagcggtgcaatggtcgtcaccagcatgacaaacgacatcattcgcgagaactcttctttcgggtagatatcacgcatcaaagcgttgataaccacgctggccgcagccgcagccagcccgtggaagaaacgcatcacaatcagctgatcgatggtttgcgccaacgcacacgccaccgcggcggcggcaaacaccagcgtaccgccaagaaccaccggcttacgcccgaagctgtctgccatcggcccgtagattaactgccccaacgcaaagcccagaatataagtactcagggtcatctgcgtactgcccgccggtacaccaaactgcgctgaaattaccggtagcgcaggcagatacatatcaatcgacagcggcatcaacatggccagcaggccaaggataaaaacaatagcaaacgacgaatgctgtcgggtggtcacaacgggctcctgaaagtcattgaaaagttagacgacgctggcaatttcttcttcagttaacggacgatattcactgggggctaaatcagcatccagcgtaatgccgccaatacgttcacgatgcagctcaaccacatggttacccacggcggcgaacatgcgtttcacctgatgataacgcccttcgctgatggtcagacgaacctgcgttggggtaatcacttccagcaccgccggcttagtgagatctttttcgttatgcagctgcacgcctttagcaaattgctctgccgtatcgtcagctacgggtgattccagcgtcaccagataggtcttctcgcaatgatggcgcggagaagtaatgcggtgcgaccactgaccatcatctgtcattagtaccagaccggtggtatcgatatccagacgccctgcagcgtgcagtttccacgctaccggttcatcaagaaaatagagcaccgttgggtgatccgggtcgtccgtggagcaaacatagccctgaggcttattgagcatgaagtaacgtggaccgtgttgctgcgccagcgggttgccatcgtaagcgacatcatgttcagggagcagtttgaacgctgcattacggacgatttcgccatcgacggtgacacgattgccgcggatttcacgcccggcaatagcacggctaacgccgagttgctgtgcgataaatttatcaagtcgcatgtgtgtgattttgcctgtaaaaaacggaggtcgggtaatgacccgaaaatctgaactgttgtctgcccagtatagcggtctaataacttccctcaagggaaaaagatccgtggcatactattagcagaataatctacctacgcgagaccatgatttttacactccgcccatatcagcaagaagccgtggatgccacgctcaaccattttcgtcgtcataaaacccctgccgttatcgtgctgcccaccggtgcaggtaaaagcctggtgatagcggaactggcgcggctggcgcgtggtcgcgtgctggtgctggcacacgttaaagaactggtggcacaaaaccatgcaaaatatcaggcgctggggctggaagccgatatttttgccgccgggctaaagcgcaaagagagccacggtaaagtggtatttggcagcgtgcagtcggtcgcccgtaatcttgatgcctttcagggtgaattttcgctgttgattgtcgatgaatgccaccgtattggtgacgatgaagagagccagtatcagcaaatcctcactcacctgacaaaagtgaatccccacttacgcctgctggggctgactgccacgccttttcgactgggcaaaggctggatttatcagttccattatcacggcatggtacgcggcgatgagaaagcccttttccgtgactgcatttatgagctgccgctgcgttatatgattaaacacggctatctgacgccgccagaacggctggatatgccagtagtgcaatacgatttcagccgcttgcaggcacagagtaacggactgttcagcgaagccgatctcaaccgcgagctgaaaaaacagcaacgcattacgccacacatcatcagccagattatggagtttgctgcaacgcgcaaaggggtgatgattttcgccgcgacggtcgaacacgcaaaagagattgtgggattactgcctgccgaagatgcagcactgattactggcgacacacccggcgctgagcgcgatgtgttaattgaagattttaaagcccagcgttttcgctatctggtcaacgtcgcggtactgaccaccggatttgacgccccgcacgtcgatcttatcgccattctgcgccctaccgaatcggtgagtctttaccaacaaattgtcgggcgcggcctgcgcctggcccccggcaagactgattgcttaattcttgattatgcgggtaaccctcacgatctctacgcgccggaagttggtacaccgaaaggcaaaagtgacaacgttccggtacaggttttctgccctgcctgcggttttgccaacaccttttgggggaaaacgaccgccgacgggacattgattgaacactttggtcgtcgctgtcagggatggtttgaagatgacgacggacatcgcgaacagtgtgacttccgtttccgttttaaaaattgcccgcaatgtaacgctgaaaatgatattgccgcccgccgttgccgcgagtgtgacaccattctggttgacccggatgatatgttaaaagcggcgctacgactgaaagacgcgctggtattacgctgtagcggcatgtctttgcagcatgggcacgacgaaaaaggcgaatggttgaaaatcacctattacgatgaagacggcgcggatgtgagtgagcgtttccgtctgcaaacgcccgcccagcgaactgccttcgagcagctttttatccgcccgcatacgcgcacaccgggcatcccgctgcgctggatcaccgccgccgatgtcctcgcccagcaagccttattgcgacacccggattttgtcgtcgcccgcatgaaaggccagtactggcaagtgcgtgaaaaagtgttcgattacgaaggtcgttttcgtcgggcgcacgaattacgcggttaatggtagttttgattgatgtataaggcgattgagtatagaatctcgcccgcttttgcatacgcaaagcagatcacttacctgttgctgggtcgcctgtagcaggattaatttaagagagaaagaaatgtttactatcaacgcagaagtacgtaaagagcagggtaagggtgcgagccgccgcctgcgtgccgctaacaagttcccggcaatcatctacggtggcaaagaagcgccgctggctgtcgaactggatcacgacaaagtcatgaacatgcaagttaaagctgaattctacagcgaagttctgaccatcgttgttgacggtaaagaaatcaaagttaaagctcaggacgtacagcgtcacccgtacaaaccgaagctgctgcacatcgacttcgttcgcgcttaattgctgaataagttgtaaaaaaccccgctccggcggggttttttgtctctgcaaattatgcctgattacggtatcgctattttttgcaggccagataaggcgttcacgccgcatctggcattcagaacacaaaaccgattaattgccgccagacgtccggcgctgcaattgatcgcgcaagttcggcggcgtgcctttaatggtcagggtatcggttgctggatcccagaagatgcgttcacctaacagcatcgcatcaaagttaatagtcaagccaccgccgctaccggcaaacttcgtcaactgacgcagtgtgctacggtctgccgggaagctctcttccagttcgtagcctttttcagccgcaaactccgtgaagctcacttcgctgacgcctgccagctctttcgacagcgattccagttcaatctcttcacctgcctgcagctgctcattacagtagctataaacctgctggcgcacgttctgtcgctctgctttatccagttgtgcttcggcagtgaaatcatcgaccgcttgcaacagcccacggttttgcgctttcgcgtttaacccttcgctggcaccaaggaaatccataaagaaatccgccactttgcgccctactcgccctttcaggaaagtgagatagcgggtcgactctggattggtttcccactcggttaaatcgatacgcgcaacaatatccgcatgattgatatcaagataatgggttgggttgatgtcgagattttcgttaacacgcatactgctcaggttgctcagaactgccaccagcagatactccaccgccagatagcgatagtggcaaaacagcacgaatccaccgtcagcaaaaggatatttcgctaattcgtcacgcaggcgaccggttgccgcgcggctaaatgccagaaagtcctcttcgccctgacgctgtaagcgcagcgtctgcgccagttcactctcttcgctaaacaagccgtaagctttatttttggcgctatagacccgatgcagttctgccaccatctcaacgacggtttccgtcggttccagcaatgaatcgcgcaacaccagctcaaggttctgctcatcacgcttgataagctggtgcagagcaatctggttgatatccagactcatgataaactctcctttaagaccgggcggtattcaaccaccgccggttaagcgacgcaataaaagatggcggtcattttacagaaggcagcgtaacgagaatgatttaacgcataaaaaagcagaaaaaaaaccgttgctacggtaatatgttgccctttcatcaactaactgatttcgatttatgccacaaatttcccgctacagtgatgaacaggttgaacaattgctcgcagagctgctcaacgtactggaaaaacataaggctccgaccgacctttccctgatggtgttaggcaacatggtcactaaccttatcaacaccagcattgccccggcccaacgccaggcaattgccaactcttttgcccgcgccttacagtcctctatcaacgaagacaaagcgcactaagggaaacagataacaggttatggtaactcatcgtcagcgctaccgtgaaaaagtctcccagatggtcagttgggggcactggtttgcactgttcaatattctgctttcgctcgtcattggcagccgttacctgtttatcgccgactggccgacaacgcttgctggtcgcatttattcctacgtaagcattatcggtcatttcagcttcctggtgttcgccacctacttgctgatcctcttcccgctaacctttatcgtcggctcccagaggctgatgaggtttttgtccgtcattctggcaacggcgggaatgacgctattactgatcgacagcgaagtctttactcgtttccatctccatcttaatcccatcgtctggcagctggttatcaacccagacgaaaatgagatggcgcgcgactggcagctaatgttcatcagtgtgccggttattttattgcttgaactggtgtttgcgacgtggagctggcaaaagctgcgcagcctgacgcgtcgtcggcgcttcgcgcgcccgctggccgcattcttatttatcgcctttatcgcctcgcatgtggtttatatctgggccgatgccaacttctatcgcccgatcaccatgcagcgcgctaacctgccgctttcgtacccgatgacggcacgacgttttcttgagaagcatggcctgcttgatgcgcaggagtatcaacgccgtcttattgagcaaggcaatccagacgccgtttccgttcagtacccgttaagcgaactgcgctatcgcgatatgggcaccgggcagaatgtgctgttgattactgtcgatggcctgaactactcacgcttcgagaagcagatgcctgcgctggcaggttttgctgagcaaaatatttcgttcacgcgtcatatgagctccggcaacactacagacaacggcatctttggcctgttttatggcatctcgccaagctatatggacggcattttgtcgacccgtacgcctgcggcgttaattactgcgcttaatcagcaaggctatcagctggggttattctcgtcagatggctttaccagcccgctgtatcggcaggcattgttgtcagatttctcgatgccgagtgtacgcacccaatccgacgaacagaccgccacgcagtggatcaactggctgggccgctacgcacaagaagataaccgctggttctcgtgggtctctttcaatggcacaaacattgacgacagcaatcagcaggcatttgcacggaaatatagccgggcagcaggcaatgtcgatgaccagatcaaccgcgtgctcaatgcactgcgtgattctggcaaactggacaatacggtggtgattatcactgccgggcggggtattccgctgagcgaagaggaagaaacctttgactggtcccacggtcatctgcaggtgccattagtgattcactggccaggcacgccggcgcagcgtattaatgcgctgactgatcataccgatctgatgacgacgctgatgcaacgcctgctacatgtcagcacacctgccagcgaatattcgcaaggtcaggatttgttcaaccctcaacgccgccattactgggttaccgccgcggataacgatacgctggcaattaccaccccgaaaaagacgctggtgctgaacaataacggtaaataccgcacttacaacttacgtggtgaaagagtgaaagatgaaaaaccacagttaagtttgttattgcaagtactgacagacgagaagcgttttatcgctaactgattaattataaatcagttagcaaaatatcttacttgcaatcggtgtggaaaacggtagtattagcagccacgattcggcacgtagcgcagcctggtagcgcaccgtcatggggtgtcgggggtcggaggttcaaatcctctcgtgccgaccaaatcgcccaccggatatcaccggaaagcaccggataagacagggataacccgctaatcacttgattggcgggtttttttatgttttttagtcaccgaacatcaccggatttataagctatcagccggattttttagttatacgtttagttatacgggctggcgtataactaaagccgtataactaaaaccctgttttttcgtgtggaatcatagacatatggcgagaaaaacacacccattaaccacagtgcagatcaaagcagccagaccagcgcaaaaggagtacaccctgcaggacggcggagggctttttctcctggtcaaaccgtctggatcaaaactctggagattttcctactaccgaccatcggacaaaaaaagaatattgctgagttttggatcgcttgaagatgtttccctggctgatgccagaaaacgccgtagcgagtacaggacgttaatcagtgccggaactgacccgcaggaccacgagaggcaaaaaagagagacagaggcccgaagacaagggaacacgttcgaaaatgtggcggcggcatggtaccaggtgaaaatcagccagaatctggcccccaacacgattaaagacatctggcgttcgctggataaatatgtattcccgttcatcggcaacacgccaatagataccctcaccgcccgaaggttcgttgaagtgcttacccccatcaaggagcgcggcaacctggaaacactcaagcgggttttacagcgcgttaatgaggtaatggattacgccgccaacagtgggctgattgatgccaatccggctatgaatgtgcgtaaggcgtttccctcacctgtaaaaaaacatatgccaacaatccgccccgaacagctgccggagcttatgcaggctttatcagtatcggcaacagaacggcagaccagattactgattgaatggcagttactgaccgtaacccgtcccgccgaagcgtcatcaacgcggtgggatgaaatcaacctggacgcgaagcaatggacgatacctgccggacgcatgaagatgcgcagggatcacgttatcccgctttccggtcaggctatggcggtgctggaggccatgaaaccaatcagccaccaccgcaattacgttttcccaagtctgaaagacccacagcagccgatgaacagccagacagctaacgcagcattgcggcgtatgggattcgctggcgtgctggtgtctcatggattacgcgccatattcagcacagcagcgaacgaggaaggattcgagccggacgtaatagaggcggcacttgcccacgtcgacaccaacgaagttagacgggcatacaaccggagcaactacatagaaaaacgcatcgtgctgatgcgctggtggggcgaatttgtcgaggctgcggcgacgggcgtaaccctcgccagtggtaaaaggggtatccgagccgtgtagctgtacagaaaaccagtaaaaactacgaaaaccatgtaaaaccgtcgtataattgcatcaaatttaacgacaaggccgtgaaacatgaaaccgttaagatgcaaaaaaatatcagatgcaattgcgacgggctgcaactggccctgatggttcagcatgaattttggtcaacctacgatccggaggacagaacgacggccccatcaaaaaaacaggtagtagattttctggtatcccgtggcgcttccagaaatctggcggtaagtattgataaggtcgtacgtccggcatctatgaagatcggaggcaggcccaaaaaatggcggtaacaatcctggaagcggcagaaatgccgctttttttataattccatttcaaatcatcaatataaaaaacggtgtataccgtttaaaaacggtgggaactgtttttacccatatccgatgatttaccgtatttgtcaccggaatacaccggattcacaaggtaaatcacgatggaagcaatcagaaaaattatctttcgccaggaagtaaaaaaaattatccacatcaaggcagacagcacgctgcaaagcatgatcaacgccggagaatttccgcagggttttcgcgttggtttacgccgtcgcggatggtatgaggatgatgtgttggcctggcagaaagaacgcgaacaggaagcacgcggaacggctgcttaacgggtatcacagatatgacaaacacgaaaaaagcggccccgatatggagccgcctttctgaacaattaacccgctgcgccttatgtgtatatgatcccaaacataagcacggggatgatagccgctatcaggctggtgggcaatgcaatcagtctggttcagttcgttgccatacctgcaatgagcgcgtttccctgtactctttaaggaattgctcaagggcaaaagcacatggcgcgaatctttctgattcatgctctatctttctgcgccgtcttttccgtgccggtgataatgttttggtcaattctttatcggtcattgtgttgtcctgcatagcaatgcgccgtaatacctcacaccacggcgctgatagtttttatcctttgggttctataccgcgccgctttagttcagtacgccccaactctttaagccagttggctaggcttatgccgtcgctctgtgcttctttatcgaattgctcttttagctctggagaaattcgcattctgaattgtggggattgcccgtcccctttagggcttttatcgcgtttgattgttgacaagtggtcacctattgaattagcctttctattgttaggtggtcaccttaacacaagagcacttaaaaaagcaaagccccgcaagtgtcattaccactcgcagggcttctaaccaacaacgtaaactaggagccgttatggttgccgtaaatcatataccacaccttgtacacacacaaacggcctttgtgtggcgttttctggccctgaatatcggagaaaaaaaccgcttgatcgccaccagcaaaaatggctatgattcccgcgcacctcataaaacgggtgtcgggattagcctcctgaaaacaactgaagcgcacagcacgcgccccgcgtgtttttttgtgccgcatagtcacaccttatcaatggtgggctgtacgggggcggagcaatccgcgccggtttcttcagtgtccggtaaggctaaccctgtacagtccgccaccagcgaaattagccttttgcgtggcggttatcttaaccacactgaggaggctgccaacatggctactatccctacccttgtacattctcaaaccgcatttatctggcgctttatcatctttggcgcgtcagaatctcaaatcatccacgtaaccgcctggacggaacgcgaagcgcgtagccgttgcccgtccggttgtattgcggtattcgccgcccgtattcgtcagggggtgtgccatgcctgatatgtcaaattaccagtacctgattaatccgcattttaactgtgagcatgatattgctaaaaaagtttattccgctgcggatggggctactgacaatatatcaatgggtgttgcgtcaattggtagcctgatgtggcatgcgtcagaaaatgaggactatgacgaaaaggccatgcgcattgatatgggtaatatcggtttgttactggcaatgcttgggcagtttgatatttcgttacggtgcaccattgaaaatgccacagatgcattaaatgccataaagaaagcgaatactgattcaaatcggggataaataatcatgagaacatatttatctggcttgactgccagcggttatgcacaccccaaaattatccccggcgctatttatctggataagaacggtaacagagtaacggtaaaagaactgatgtttgaccgtgtttattttatccgtgatggatattcatttcttagttcgctgaacgtggagatctttatttgcagattccggcgggaaatcccgacttccagaaataaccatgtgtcacgtgtggatgtggataaaaaactacaggaactgaaaaacatgattgccgcgtggagagagcagaaatgaaaaaagcgccaaatttaaaacaccagccgcgtgacaaaatgacggaagtcatcatttttgcgggtagtgatgcctgggcacatgcgaaacagtggcaggaacaggacgggcgactggctggcgataacgtgcctcctgtctggcttggagagcaacaacttgccgaactggataagctgcaaattgtgccggaaggccgaaaatcagtacgcatattcagggccggacatcttgagccagtaatgatcaaggcgattggtcagaagctggcggcggcaggcgtacaggatgcaaatttttaccctgatggaatgcacggtcaggaggtggagaactggcgcgaatatctggcccgtgagcggcagaatctttctgatggtctggttattgagtttccggtaaagaaaaaagataccggaagccatagcgatgacgaattaaagccacgcgttgaaagtcgcgccgatggtgttttctgggtaacgcccaaagtggataagcagtcaggcgaaattatccggcctgagacgtggttatgttctccgcttgaactactgggaacggggacgatcggtaaagagcattaccgcgtcatgcgctggaaaaaattagcaaatcatgaagtcatcacaatggcgatcccgtgtggtggcattggcgaccgtgacggctggcggttgcttaaagatcacgggctgaacgtgacaacaaacggcaaatacagggctatcctggctgactggatgcagttaagcggaagccatgaggaatggcagttaagcacaacaacgggctggcattttgacgcgtacatcatgccggacggttcaatcattggtgattctgaaaaaccgatcctgtttaccggaaaaagtgccgctattaatggctattcggttgcgggtacggcggagggctggcgcgacagcgtggcgcggctggctggtggcaatccgtccatgatgctgggtattgccacgtcactggcagcaccgttgattggccttgttggtgctgacggcttcggggtacatcttttcgaacagtcatcggcagggaaaaccaccacgcagaacatcgcatcaagtttatggggagagccagactcacaacggctgacctggtacggcacagcgttaggtatcgctaacgaggcagagtcgcacaacgacgggctgttacccttggatgaaataggccaggccggaaacgcgcgggaggtgtccacgtcagcctatacgttgtttaacggttccgggaaattacagggggcgaaggacggcggcaaccgggagataaaacactggcgcacggtggcaatcagcaccggagaaatggacgttgagacattcctcaaaacggaggggataaaagtcaaagcggggcagcttgtccgcctgcttaacgttccgatggaaaaagccacgcactttcacgaatacagcaccggaaaggcgcacgcagacgcgttaaaggatgcctggacagaaaatcacggggcagcgggtcgtgagtgggttaaatggctggcaggccaccagcaggaggcaaaggatacggtaagggaatgccgcgaacggtggcgcaacctgataccggagagctacggcgagcaggtccaccgcgtgggtgagcgtttcgccatactggaggccgcgcttgtgctttccggtcatgtaactggctgggccgcgcaggaatgccgggacgcaatacagcataactttaatgcctgggtgaaggagttcggcacgggtaacagggaatttaaacagatggttgaacaggctgaggcgtttttgtcgtcgttcgggttcagtcgataccttccttacccaaacagtgatgaacgtgatttaccgattaaagaccttgccggatacagaaaggggagtatcagaaatgaagatgatgagttccgtttttacacgtttcctcatgtgtttgagggggagatcgcacagggatttaacccgtcccactttgcccgcgcgttgagtgctgcaggaatgctggaagcgggtaacgatcgccgttacaagaaaaaggcgctcggcaaaattggggggaagcagcatgttttttacgtactgatgttccagcctgaggcagaagattaccccccctgtgtgaggtgaaaagttgcgggttatgcgggttatcctgtgtataagtgcattaactacatgaataaaaaggaaattaataacccgcacgtaacccgcaaaacggcagttataacccgcaaaagtgcgattataacccgcagatgaataacaggaagtgacagcaaacagccacgcgtaacccgcagaaaaaaaccgtttgcgggttattttgagcattttgcgggttacgccccggctaaacagtatacagttaattttgtaatatattgatattaaggaataaaaaatacttagcaagagaagataacccgctaacccgcataacccgcactgttttgtatatatatacgaaaaattgagatctgaactatgaagtcaaaccgcaaacaaccacactaccgcgctattgaccttacagagcactggctgagagtggcgataaaaatcatcgaccgaaacacggggaaggatatgcaaaagcacatcccgaactgataagcgcattcatgacaacggcggcggcaaactttgccacgatgacagaacgggagattgccgaagcggaacaggtgacaaccatcaacgttaaaaccggagagcagacagcatgacagcacagatagcggcttacgggcggctggtggctgacccgcagttaaagaccaccagcaagggtacacaaatgacgatggctagtatggcggtcccccttccgtgcagccaggcagatgacggaacggcgacgatgtggttatccgtcctggcgtttggcagacaggccgacgcactggcaaaacaccacaaaggcgaactggtgagcgtggcgggtaacatgcaggtaagccagtggacaggccagaacggcgaaacgcggcagggctggcaggttatcgcagacagcgtaatcagtgcgagaacggcgcgaccgggcggcaaaaaaggccagcaggggcaggctactgacgcactgaacagggcaaaacaacaggcgggtaacgatgatccgtacggggataacataccgttttaagcgacgagtgacagaagccggagcaatccggcttttttacgggttctcctggcggggtgggcctgaacacggggcgggaggcgcggaaaaaagcgcatttttgtgattttatcgtcatcatcatcatgagcgtaatttattgtttttaattgttttgatgcaaaaaagatgatggttgtggttaatttttgttcgacatctttgcaggcagataaaaaagcccgataaggtcagaggtggcttatcgggcttttgcatatgaggttttttggtgcactgacacacatgatcgggataatcatttcataatttgcaacacaactcaatatcattgcacaaaatgcaatcatgattataatcataactggatgaacatccagttatgattttttaagtcaaagaggaatttcttactatggctgaagagaaaaaaggcggtatttcggtgtacataagccccgacatcgtgaaggcgctcaaggaacgccaccagcagaacgtaaaagcaggcattgcggcaggacttgatccgctggcgatggttgagccgtcaacaggctggcaggtacgcgcctatttacgcgcggcgctgggtatgaatcaggttcacgggggtgaataatgacagtaaaagcaatatcacttaacactaaccagctttttgcgtacctgaatcgcgaggatattgcggaatttaaattcagtccgctgtttaccgcgctgtttttcccgaacgtggcgacattcaacacacaggacatcatgttagataacctggatattgaagaagtcactatgtcggcgttttgttcgcctatggtgggtagccaggttcagcgcgataaagggtacgaaacaagcattattcgccctggctacatgaagccaaaacacgaaatcgatccattaaaaacaataatgcgcatggctggagaagatccagcacagcttaacgaccctacctaccgccgtatgcgcctgattactggcaacatgcgccgccagataaacgccattaaagcgcgcgtggaatggctggcggtaaatgcggtaacgaccggaaaaaacatcattgagggcgaaggcatagagcgctatgaaatcgactggaagataccggaaaaaaacatcatagagcaggccgacggtaaaaaatggtcagagcaggacaaagacatacacgacccaatctatgacattgagctatacgcagatcaggcaggttgccccgcaaacgtcatgattatgggcgttgatgtatggcgcatgttacgcagctttaaaaaattccgtgaactgtacgatctctcccgtggttcagaatccgccgcagagctggcatgtaaaaacctgggcgaagtggtgagctttaaaggctatcttggtgatctggcccttatcgtctattccggcaaatacactgacagcgacggcacagaaaaatatttccttgagcctgatttgctggtcctgggcaacaccaacaataaagggctggtggcctatggtgcgattatggaacaggaagcggtaagaacgggcgcaacgcaaaacatgttttacccgaaaaactggattgaggacggcgatccggcgattgagtacgtgcagacgcacagcgcaccgcagccggttccggcagatattcgcaaatttgttaccgtcaaaattggttaacggggggattctatggacactccatacattgagttatttgcaggcagtcagcaggtatccacgacgctggtacattttgccgctgatgctggcgttattcaggaatttaccccgctgatgctggcggacaatggcgagtttaagccgtgggatggtcaggaatctggcaaggctgtttatctgacttcgtaccccgtggacacgtcaaagcagaaatcagcacagtgttacaagacggggatatttaatatcgccgccgtaaactggcctgagagcgccgacactgacgcgaaaaaatgcgccgcctttgcgggttctggcgtatccgttcagccgctggcgcgataagcaggggaaacgatggcaacgaatgaaagcatcatggcgctaccgctggcgagtaaatttaaagcagaagcgcgggcaatggctgacagaggtttatcaacctacgaggccgtatatcaactcaacaaactggaagaacaggacaagccgcgcgctgatgcgattatggcgcttcatgaacataacgactatcagccgctgttacgtgcaatggcaaacgtgccatgtattagcgtcgataatgctcgtgaaatcctgaacatgaccatagagcaggagcgcccaaaggttgcaccagagcttaccgcagcctttgaaaactttatggacatgcacagcccgcaagccgtatcagctggcatggcgtacgatggcagaaaccagggcgatgacggcgacatcgatcgcatactgaaaaccatctgagacaaggccggagaaatccggcttttttttacgggtcctttccggcatatggacccgttacggggcggcgacctcgcgcgttttcactatttatgaaaattttccgggatccatgtccggtttctctgcaagttaaccatatgaaaaatataaaaacatgctttctatgaaccggacatgcgcaaaaaacagacactaaaaccggacatcgtacccgttaaccggaagtgtgcaaaaatcacacgcattgctgcgcgtgattaacaatttatcggctttactgttctgtataggctgggtggcgtcatgccgtagccgttctccgtgccagcatggaataatccgtagttacagagcggtaaagttaaaaatcactttctgttacgccatcaaatacgcgatacaacaaccttgtgtttttacaaaaccatttgatatcattgaattttttcacattaatgacatcaaaatacatcgtaaggttgttgtatttattttatttttaccttacttatcaattagatataccaaacaattaaacaacaaccaccccctcaaaaaatctcataaatagcgaaaaaccgcgaggtcgccgccccgtaacgggccataattccaggaaggacccgacgacaccagactatcagaacgatgggggcacaatgacagaagccgaaatactgggattaatccgccgcgttgccggaatcagccagcaggttgacgaacaggccacgcagccggacagcgtgaccgctgaaaattatgcgcgtgttgttgcggaggtgatgcgccgtgatggtatagaacttaatggcgtggatatgcgcaacatacgaaccagagttcttgagttgctggcctaccgtcgccgcgtggagatgtatcgggagaaggagaaaataacgtaccactggaagaagccggagcggttgcggcggtaactggttgatattcccgacggaccaaaaatgggtggctacatccctcgcttctgaggactgttaacaagctgcctgaaagacagtcacaaactacgaaattttcgcagtttaattaatgatcagcttaatcgctcacccgctgatattttcggaaacctcaatttgaggaagtcggcgcggtaactcgctgaactttaagcaaagcgcaaaattgcgcttgctgaataatcattatgattacgcagatgattaaggaatgaccgaaggcggaaattcgcctgtggttaatgggggagttgcagatctgcaactcgaccatgaaactacggaaactacccgtagtttgggtagtaagagtaacacccagattttggggcttactcgtgatacccaaatttggggtatcggtggcaaccataacgactttcgttacggttgatgcttttaccccattggtggaggctgggcggcctgctgtgggcttttccaccattggtggaaaggtgcagatctggatcatcattacggtgatcaagggtatgtaaaacccaccagcctgattaacagttaaccggaaaaaaaatccggcatgggggggagtggttagccacgaacaacgaataagctggacaccgcgccccctctcacgcagagaaaaaattaccgtttcgtagtagttaacatgttaactgcctgatgaagcgttgttgttgattttttctttatgattcatctggttgcgtgcaaaaaatgttaactacctttttggtaaaaatgttaacagggcagcggttaacattaaccaggcgtaaatcccgatatggtgatccccatatcggggaacatccaccagcttaaaaacgaatgagcgaaaaaaatccaggtagaattatggaagtcgctagggcaatcgccgtttaaattgtgcattttttcagcaaattattttagttatacgtttggttatacggtttaaaagctgaatcgataatattgattaaaatcatactgttacacgctcaattaaactactctcgtgaaaaatcccaagaaaaccaacctattgcggttggtttttttatatctgcatttaattcgataaacagaccgcgacacatcacggcctgtttattttctgttatcagaacgtccagaccacacccgcctgagttgtgctgctttcttcacgggagaaacggctgtcgataccgagcgtcaggcccgtcaatgtttgctcaaagccagctcccgcatcagtgttcacgttgttgcggctgttaattaccgaactccacatcgccgtatcgtaattaacgccttttacgctaccaagacgcccacgcacggtgtccagttctgcatcaaataccagcggttgtgctgccgccatattcagcacatccgtggttgaagggggcatttgtacgcgattctctgcgagactccagctatggttgccattatccagcaaggtatattcatacgtactgatatcaacaacgcttccggcattgcccaacgtaaatgccgcatcaccgcgccctcctttaatcgtgggatcagtcgccgcgccataaacctgtagcactccattattgatcgtagtctggtttaccgcgccacccatttgaacaatttgataaccatcatttaatactgagtattctgcggtgccatttatttcaatgtactgatatcccccgttaatttcagtattactacttacaccaaattcttatatatgctgttctccgccaggattgattttcgtattattggcggccccataaaccagctggatatctttttccagaacaacaccatcaactgtctcaccatactcaacagttgatgccaatgctatgggtgaatataacgctgtagccaccagaacagatattgcggaacgacaaagagaaacagaaccagattggtgcattaagctttcatcctatgaaattaattgctgttaaaagcattggggacagaaaatacccatagctccatacccggagtcagttttaaaaaactgtttaaagaaatgcacaagtattgtgattgattttttagttgtttttcctgatgagaagctgatgcaaaattccgtctttataatgaagatgatgccaaagcgaacgacaaagttgtagttttcactacatgtccatacataaaatggggtaacattcacgcgcctggtagcgttaccaacgctacgctcaaacataatgattctaataaaacctcaggagactactatgcctgaagcaacgccttttcaggtgatgattgtggatgatcatccacttatgcgacgcggtgttcgtcagttactggagcttgattctggctttgaagtggtcgccgaagcgggcgacggcgcaagcgcgatcgatctggcgaatagactggatatcgacgtgatcttgctggatctcaatatgaaaggcatgagtggcctggataccctcaatgccttgcgcagggatggcgttaccgcgcaaattattatcctgaccgtatcagatgcctccagcgatgtctttgcactgatagacgcaggcgcagacggttatctgttgaaagacagcgacccggaagtgttactggaagcaattcgtgccggagcgaaaggcagcaaagtctttagcgaacgcgtcaatcagtacttacgtgaacgtgaaatgtttggcgcggaagaagaccccttcagcgtgctgacagaacgcgagctggatgttctgcacgagctggcacaggggctgtcaaataaacagattgcctcggtgttgaatatttccgagcagacagtaaaagtccatattcgcaatctgctgcgtaaactcaacgtccgctcacgcgtggcggccaccattctgttcctgcaacaacgcggggcacaataaaaatagcccgatggcatcaccatcgggccactttttatttactctcctgcggcgacaaatgttgcatcgcctgcgcgatactacgttcgatcaccgcacggcgagtatcgttggcaggtaagagtttcaacatcatctcccacgcggcaacggcttcgccaaatcgttgctgctcaaaggcattaaatgcatacatgcttaacacacggatattgctatggtccgttctcaccaactggcgcagcagttcgccgccgaggcggttgtcgttgggatcagatgaacgtgtcaacgcttcagcgtatcccagtgcagcatcgctgtttttcggatcgaggcgatacgcagtggcgtatgcatcggtggcgatactggcgttacccagcgccatgccaacgcggcccaacataatccagccttctatatctcccggatttttttgcagttgagtacgcatccccagcgcaaggcgcgacatctcttcttcgttgagcggatcggctttcggatccagcgccctgtccagtaacgccggagcctgtgccgtggcctgctgccagattttcacctgctgataattgccagtctggtagtagctgacgccagccacaattaacgccaccacaatacccggcagataaacaatatatccggcacgcttaccttccggcacgctttgttcaggaaacgcgtccggcaccacgcgtacccgacgccgcgaacgggcgtaaatgacccaaccgccaatgccaatagccactaccggaagcacccacagcagcacggtcagcggcgttaacggcggatcgtaagtgacgaagttgccgtaacgcgccaccatataatcgacaatctctttcttacttttaccttcctgcatcagttcatacactttctggcgcaggtcggtggcaatcatcgagttggaatcggcaatgctgttgttctggcatttcgggcagcgtagttcttcagtgagttggcggaactgctgctcctgcgcttcatccttaaactgcaacacgtcgatggtcgccagcgctgagccggagatcatcagcatcagcacgcccaataaaaacctcattgtgcggcctccttactgtatttctcccacagtggcttgatctcttcttcccagacgcgaggattgagatcgcccgcatggcgatagcgaatgatgccgttgccgtcaataaggaacgtttctggcgcgccatagacaccgagatccagccctaacatgccgtcgccatcaaacaggcttagcgcgtaaggattgcccagctctttcagccagctgattgccttctggcgatcgtctttatagttcatgccgaccacgcggatgccctgcgcagaaagctgattcagatattgatgttccgcacggcaggtcggacaccaggtcgcccagacgttaagcagcactggtttgccctgagtcagcacatccgcctgataaaactgccccggattgtccagtgattcgaggcgaaacttcggcactggcttgccaatgagcgccgattccagattggtcggatcatccccttcggcattacgcgccagctgccacagcagcgccgcggtaatcgccaggaagataatcaacggaattaacaataccttgcgcttcatgcagcctccggcgcagttttctgcgggttcacgcgcttacgatagcgaggatcaaacagacacagcagtccgcccaacgccatcatcagcccgcccgcccaaatccagcgaacaaatggtttgtagtaaagacgcacggcccacgcgccgttttccagctcttcaccgagcgccgcgtacaggtcacgcgtgatgccaccgtcaatcgccgcttcggtcatcatcgacccggcagtgttgtaataacgtttttctgcatacagcactgtttccggctttccatctcgcgttacgccgatggtcgccacaccgccacgccagtttggaccagtcacttctttgacatcacggaaggtgaagcgatattcatgaatatcgacgctatcgccggacttcatgcgcacatcacgctcaacgctatagttctgactaaaagcaatgccaacaattgtcactgccagccccaggtgagctgccaccatcccccaataactgaaggtggttttcgtgccgcgtgaaatacgcagcgcagcttccgcaattgccagcaccgcaatccagcaggccattgccaggccgagcaccgtcatcgccacaactttgctttcgaacagccacggcaacagcagcgacagcaccagcgtagagatgaaggcgataatcaacaaattgcggattttacgtgggcgatcgcgtccccagcgcaccagagggccgacaccaagcagtagcgcaaacggcaccatcagccaggtaaacatggtgttgaagaacggttcgccaatcgaaatactgcccagtcccagttgcttgtgcaccagcggcagcaacgtccccagcaacaccaccagcatcgcggcgaccagcaaaacgttgttcgctaacagcaaagattcccgcgaccacagcgcattgtttacgcgtgagcgaactttgtgtccacgcgcggcaaacagcagcagcgaaccgccaatcaccagcaccataaaggcgaggataaacataccgcgcgccggatcagacgcaaacgcgtgtaccgataccagcacgccggaacgcaccaggaaagtccccagcagacacaacgagaaggcactgattgccagcagtaatgtccacgctttgaagctggcgcgttgttcagtgaccgccagtgagtgcatcagcgcagtccccaccagccacggcataaacgaggcgttttctaccggatcccagaaccaccagccgccccagccgagttcgtaataggcccatgcggaaccgagcacaatgccgagcgtcaggaagatccacgcagccagcgtccacggacgagtaaaacgcgcataagtgctgtccagacgcccactcaacaaagatgcaatggcaaaagcaaacgccaccgagaagccgacgtaccccatataaagcagaggcggatggaagatcagccccggatcctgtaacagcgggttaagatcgcgaccttcaatcgggaagttcggcaacgtgcgtgagaacgggttagaggtaaagagaatgaacagcaaaaagccgacgctgaccatccccattatcgccagtacgcgggccacaatatccagcggaatacgctgactaaaaatcgctaccgcaaaggtccagccgctcatcagcagcacccacagcaggagcgagccttcatgcgcaccccaggtagccgccacgcgataccacaccggaagctgggtattggagttgctggcaacataggtgacggtaaagtcgttgaccacgaaagcattgaccagcaccagaaatgcgccagccacagacataaacagcagccaggcaaacaagcgggaagacgccatcatgcgcgcgtccccgcgcgccacgccccatagcggatacacggacagcagcagcgcaattcctagcgccagacacagcagcccgttaccaatttctggcatcatgatgctgggtccttataaacactcgccgggcgacggtggttagcttccatcgctttctcaacttctggcggcgtgtagttttcatcgtgtttcgccagcacttctttcgcgaggatatgattgcctttttccagttcgccctgcaccacaacgccctgcccttcacggaacagatccggcaaaatgccttcgtaagagacatctactgaaccttcagcgtcgtaaatggtgaaagttacttttagcgaattgggatcgcgctgcacactccccggcatcaccatcccgccaacgcgcagacgctgaccgacttccggcatctgctgagtttcacgcttgccgtagagaatctcccccggcgtataaaagagatcgatattcgagcgcagcgcatatagcaccagaccgatagtcagcgccagccccgccagcacggcacaggcaatccacaagcggtttttacggcgaatattcatgcagcctcctgctgttgcgcagcacgtaaacgcgcctcacgcgcccgctgttgcgccacgccacgcagaattgcgcgatgttgcatcaccgagtgcacgaccaaaaccaccagcggaataacggtcatcaccaccgccaaccagacaaaaaaggcgtaaccgcccattgcgaaaaattcattccaggaagcaaatgcaggggtcatttacggcctcttttcagtatcagttcactcacccacggacggcgtttttccatcagcaaaatcaaattacgcatccgcatcagcgtcagcgtggcagacaggagcaggaagccaaaaatcgaccagcgcagcggcgaacgcatcgccggatcgatactttgctgcatccgcgttgatccctgatgcagggtgttccaccactccacggagtaatgaataatcggcagattcaccacgccaatcagcaccaggatacctgccgcacggccagccagacgacggtcgtcgaaggcgtgccacagggcaatgacaccaacatacagaaacagcagcaccagttcagaagtcagacgtgcatcccatacccaccaggtgccccacatcggttttccccatgcagagccggtaaccagggcaataaaggtaaacacggcaccaatgggggccatcgccgccaccgccaggttggccattttcatctgccagaccaggccaataaacgctgccaccgccattgatgcataaatgcccatcgaccagatcgccgcaggcacatgcaggtagataatgcggtagctatttccctgctgataatcagccggagcaaagccgaacccccagatccagccgacggtaagcacgaccacactggcaattgccagccacggtataaaccagccacagatttgatacagccgtggtgggatcgccagttgatgcagtgttttccacatagtttcgataccagactcgaacaaaaatcagtaatccagcgttattgaatgctgattcgtaacgctgccgccgtcgcaaaaggacttaatgtcgcggtgcctgccagcaacgcgcctaaaattgccagatacccatcaacgggcaaatgcatagaagccgcgtccatcgcggcggtggcaaagatgagtaatgggatagtcagcggtaacaccagtatgctgagcagcacaccaccgcgcttaagtcccactgtcagcgccacgcccggcgcaccaagaaagccaagcgtaggggttcccagcagtagcgttaacgccatcacttgccagccataaacatccattcccagtagcattgctaccaggggcgaaaggatgagtaacggcagaccggttaccatccagtgcgccatcaccttcgccagcacagcggcgggcaagggtaacggcaacaacatcaattgttcaagactgccgtcctgcaaatcgtcacggaacagtcgctcgagtgccagcaaggatgaaagcagcgcggcaacccagataatgcccggcgcaatacgcgccagcagttgcggctccggaccgatactgagcggaaaaagggtaattacaatcaggaagaaccacagcgggttggcgatttcggcgctatggcgaaacgctacgcgcagctcaagacggaaaatgcgccagaacatcatgcggcccccgtttgcgtcagtgaaatgcggcgaattttactttcagcaacgttgagcggctggtgggtagtcagaatcacaatccccccctgctccgtatgctgcgccatacgctgggtcagacgatcgacgccgttaacgtcaatcgcggtaaaaggctcgtcgagtatccataacgtggcacgggtcaaccacagacgcgctaaagcgacgcggcgttgttgcccggcagaaagttgatttaccggaatatcttcgaatccggcaagcccggcctgcgccagggcttccagacattgtgcggtatcgccatcgcgatgataaaagtgcagattttctaacgccgtcagccgggttttgatccccggctgatggcctatccataacaggttttgatggtagctgtcgcgtacctgatgcaagggctgcccttgccagagaacctcgcctgcatcagggcgagacaaccccgtcagcaaacggagaagcgttgtcttccccgcgccgttgctaccggtgatttgtacccactctcctgcgttcagcgtaaatgataaaccactaaataaggttcgttcatcccgctcgcaaagtaactctctggcttcaagcatacccacgcaataaccctgttaaaaacctggctcgacttcacgcatgtcgggcagcttgtgcgctatccctttatggcaatcaatacaggtttgcccatctttcaccgcctggtcatgcatcttcgcggcaaccgatttctgggcggttgtatccatatactcgaagttgtgacagttacggcactcctgcgagttgttgtccttcatgcgccgccactcattctgtgccatcgtcaggcgatgagcttcaaatttctgcggcgtgtcaataacgccaaaaattttaccatacagctctttacttgctttgagcttgcgtatcatctttggcacaaactcgtgcggaacgtgacaatccggacaggtcgcacggacgccgctacggttgttgtagtgcacggaatccatgtattcctgatacaccgtgttacgcatttcgtggcagctaatgcagaactcttcggtattggctttttccatcccggtgttaaagccgccccagaagacgatgccgccgacaaaaccgatcaacagcagcgtccctagcgccagacggctgggggtacgccaccatttccacaggcgcttaatcagaccaggcttacggtcagaatttcccataataacctcttatttcccgtaaccttttgatggggtaaaggtattccccacgattggcgcggtatcggcctgcggtacgtgacattgcagacagaaataacgacgcggagccacttccgcgcccactttgccgtcgctgtccataaagtgagtaggactaatgcgcggcgcgccagtggtgcgataactttcgacaccgtggcactgcaagcagcggttggtattggtcgttacctgataaccttcaacgctatgcgggatcattggcggctgattcacatagttcagcggcatccgatcctgctcttttggcatccgaatggccccttcctgcgtcccggatacttccggcgactggctaaaatcgacgccattagccgcccaaaccgcgccgcttaccaccagggccagcatcgccgtccattgacacagcgctttcttcaggtcatggcttttcatgatttcgctcccgaactccatcgtgtagttattgtaaatacatcctcagaacagacatccacgcagcgaccgcacgtcatgcaatcgcggctggtgacctgcaccgggctttgttcatccagcaccggggcacgtagcacatgcggttccgggcaaacatgaaaacaatccatacagcggttacatttctgccgatcggtggccgcaacggtaatcacacctttgctacccagcacgccatacagtgcaccaaccggacaaatgtgcccgcaccagccgtgttcaacgaccagtagatcaaataaaaacagcgcgagaataagcagcgcgccgctgccgaagcccattaccaggctacgccccatcagagaaacggggttgatccattcccagatgagcgtgccagttaaggccgatcccaccagaatgaccaccaacagcacgtagcgaatatggcgagggatcgtcgcagactgattgaggtcaaatcgtctgcgtaaccaatttgctaagtcggtaatcgggttcagcggacagacccagctgcaaaataatcgctttcctgccagggcgtagagcacggtgataatcaccgcaccggtcaacgccaccgtggcaggcagatgaccgctggcaagactttgcagtgtcatcagcggatcggtcagtggaacggtgtcgaataacaggctactgctgtagttgccgtgcaagatccacacaccaaaccacggaccgctcaaaaacatccccagcacgaagaactgacaaaggcgacgtaacactaaccaacggtgactgcgccaccagccttttttctccagcgcctcgcgcccggcgtcacgtttacgatttgccattgttcccctccagccagccgaagcggtaatggtgacctaactcccctttcgccagtgacagcggtaacaccttgattgccggttgttccagcacgcacactttttcgcacttaccgcagccggtacaggcgtcgctgtgaaccgtcggcagaaagcgggcgtgcttaccggtacgcgtgttgcgctccagctccagggtgatggcctcatcaattttcgggcattcgcgataacaaacatcgcagcgcagcccctgaaagttgagacagttttcctggtccaccagtaccgccagccccatccgcgcgtcgtcgatcgattcgatctcacgatccagcgcaccgctcgggcacactttggcgcacggaatgtcctcacacatttcgcaaggaatatcccgtgcgacaaaatatggcgtgcccgccgacagaccagaggccagggtcgccagttttaaggtgtcgtaagggcaagcctgaacacactgaccgcaacgcacacaggcactggcaaaggcgttctcgtttatggctccgggcgggcgcaaccgcacgccagatgcgcgtgcggtttgctgttgtaaccccagcgccacacccacggcagccagcccgcctgctgtgcgaacgacatcgcgcagaaagcggcggcgaccattttgaggtttcgctgaccgggacataatggcttacaccttctccagtttgaccgcgcacttcttgaagtccgtctctttcgagagcggatcggtcgcatccagcgtcagtttgttaaccagctgtgcggcgtcgaagaacggcatgtacaccaggccctgcggcggacggttacgaccgcgcgtttcgacaatcgagatcacttcgccacggcgagaaaccactttcactttgtcgccacggcgcagatcgcgcgctttcgcatccagcgggtgaataaacagaaccgcttccgggaaggcgcggtgcagttccggtacacggcgagtcatactgccggtatgccagtgctccaggacgcgtccggtagagagccacaggtcgtactcttcatccggtgcttccgccgcaggttcgaacggcagcgcgaagatcaccgctttgccatccggtttaccgtagaacttgtagccttcgcccgctttcacgtacgggtcgttaccttcgctgtaacgccactgcgtttctttaccgttcaccaccggccagcgcagaccgcgtgctttgtggtaatcatcgaacggcgcgagatcgtgaccgtgaccgcgaccaaaccatgcgtactcttcgaacagccctttttgcagatagaagcccagctcgcgggattcatcgttcagctgatcttccgccagttcggataccgggaatttgctcacttccggagtggcatacagaacgtcgtacagcgttttgccgcgcagttctggtttcttcgccagcaactcttccggccacacttcttcagttttgaagcgacgggagaactgaactaactgccagagatccgattttgcttcacccggtgcctgtacctgctgacgccagaactgagtacggcgttcggcattaccgtaagcgccctctttctctacccacattgcggtcggcaggatcaagtcggctgccagcgcactgaccgtcggatacggatcggaaacgatgataaagttgcgcggatcgcgccagcccggcatacgctcttcattaatgttcggtccggcctgcatgttattggtacacatggtccagtaaacattcagtttgccgtctttcagcgcacggtcttgtgccaccgcgtgcagaccgattttcgccggaatggtgccactcgggatattccacttcttctcgcaaatatcacgatgtttctcgttagtcaccaccatgtccgcaggcagacggtgagcaaaggtgcccacttcacgcgcagtaccacacgcggaaggctgcccggtcagggagaacggaccgcaacccggctgggaaattttgccggtcagcaggtgcaggttgtagaccaggttgttggcccacacaccacgggtatgctggttgaagcccatcgtccagtaggagatgactttcttgttcggatcggcatacagctgcgccagttgttctaactggtctttcggcacgccggtcatttcggcggttttttccagcgtatattcagcaacgaaggctttgtaatcttcaaagctcatcggttcggaggcgtcagaacccggattcttcgctgctttttccagcggatgggtcggacgtaaaccgtagccgatgtccgtcgcccctttgcgcaggttaacgtgtttgctgaagaagtcctgatttatcgcattgttttgaatgatatagttggcgatatagttcaggatcaccaggtcagattgcggcgtaaagatgatgccgttatccgccagctcgaagctacgatgctggtaggtagaaagcaccgccacggtgacgttctggttagaaagacgacggttagtgatgcgcgaccagaggatcgggtgcatctccgccatgttggagccccacagcacaaacgcgtcagcctgctcgatgtcgtcatagcagcccatcggctcatccataccaaaggtacgcataaagccaactactgccgacgccatacagtgacgcgcgttcgggtcgatgttgttcgaacggaagcccgctttgaacaacttggacgcggcataaccttcccagatagtccactgaccagaaccgaacataccgatcgattccggccctttttctttcagggcggttttgaatttatcttccatcacatcgaaggcctgatcccaggtgattggggtaaattcgccttctttgtcatatttaccgtttttcatacgcagcagcggctgcgtcaaacggtctttaccgtacatgattttgggcaggaaatagcccttaatgcagttcaggccacggttaaccggtgcgtccgggtcgccctgacaggccaccacacgcccctgctgcgttccgaccagaacgccgcaacccgtaccgcagaaacggcacggcgctttatcccatttaatggcttcctgctgaccaacaacggcgcgggcaacgcccggcacgctgagaccggcagccgccgcagcggccgcaacggcgttagctttcataaagctacgacgactgagtttcatggtgtttcctcaccttgctcttcctgctggtgataaaccagcgacaccgccagcacgccctctacgttgcgtactgactcaatggtttggatcagcgtttcgctgtcttctgcttccaccaccacaatcaactgaccgctcggcgcgtcgctgacagcaacttcacagccggtaaaggcgttcagttgggtgctgatgtctgaaattcgttcgcttttggcctgcacgaccaggctgcaaacttgccagttagtgtgcatggagatactccgcagttatggctgataccggacagctggctgcacatgctccacatccgttgcaaagttggctattaagttgcggctggtagatcccggagagcgtcgggcgaaagataattgccattggctcacagctatcctgacagcggcggcattcaactgactgatacgccaggcacgcgtccccaatggtgaactgcaaatcccaggccctggtgtggcgcggagaaaatagcgattcggggcaagcctgcgcgcaggcgtaacagaagctgcactcgttatttttgaaattaacgctcggatagccacccgcgccgcgttgcagaatgttgttttcacaagcattaatacaggcgtcgcagcgggtgcaatgggtcagaaaatgagattcatcaccggaccagggcggacggataccgttactggctttgcgccagcgaccagtgagtatgccccgacgggatgcatcaatcttcacattgaccttccatcattaacgcgctctgaaaattgagagcgaccaaataaaccgcataattaataagccatttttatagccgctaagatattaaaggatgtgtcaaagatgcataccccgatcggggtaaaacctgtagcaggatcaaaagagtggcgggaagcgtggcaaaaacgggcttttgctcacatttcaaatggttataaacatatttatatagcgattaattcgccagagatatttctgctggtttgttttctcatcagaatttaacactaaaagagcaggtaaaattatctgaatgttctttaagttattcataaagcaaattaataaatctgatgaatatgttaaccttcagcgacatcatcggtgaaaacctataaatgaagaaggaaagcaaaaaaatgaagaccattctacctgcagtattgtttgccgctttcgccaccacttccgcctgggcggcagaaagcgtccagccactggaaaaaatcgcaccttatccacaagctgaaaaaggcatgaagcgtcaggtgattcagttaactccgcaagaagatgaatctaccctgaaagtagaactgttaatcggtcagacgctggaagtcgactgcaatttgcatcgtctcggcgggaagctggaaagcaaaacgctggaaggctggggctatgattattatgtctttgataaagttagctcaccggtttccacgatgatggcctgcccggatggcaagaaagagaagaaatttgtcaccgcgtatctgggcgatgctggaatgctgcgttacaacagcaagctgccgatcgtggtgtatacgccagacaatgtggatgtgaagtaccgtgtctggaaggcggaagagaaaattgacaacgcggttgttcgctaaactgctgtgaagtgctgcaacctgtaggccgaataaggcggttacgccgcatccgacatctaacgcccgagccggttgcctgatgcgacgctgaagcgtcttatcagcatacgccacatccggcaaaccatgccggatgtggcacatcattacaacgcaatatccgccacttctttttgaacgggttgcggtttcaactgcggtttcggcgtactatctgctgcctgcggcttgtcgtatttcagccccagcacttcgctggtgtactgcaactcgcgttctgttgccgctacatcaccgttcagcttgcgtccataagacggaacgatcgctttcaacgtagcctgccattgcgggctggaaacgcgatcgccaaatactttttccagcagattcaacataatcggcgcggcggttgacgcccctggcgatgcccccaggagcgcggcaatggtcccttgctggtcactgacgacttcagtacccagacgcagtacgccacctttatcggcatcacgcttgataatctgcacgcgctgccccgcttgccacaaacgccagtcctcttttttcgcctgcggatagtactctttcaacgcttcaaaacgatcctcttcactcaacatcacctgactcaccagatatttcaccagatcgaaattatccagcccaacgtgcatcatcggcatcacgttagaggtggtggtggaactcatcagatcccataatgaaccgtttttgaggaatttggttgagaaggtggcaaatggcccaaacagcactacgcgtttaccgtcaagaacacgggtatcgatatgcggaaccgacatcggtggtgcgccaacggatgctttaccgtaaaccttcgccagatggtgattaaccacgtccgggttttccgaaacaaggaactgtccgcccaccgggaaaccggcgtagtctttcgcctccggaatccccgattcctgtaacagtttcagcgccgcaccgcccgcgccgataaagacaaatttggcgcggatgttctgtgcagtgccgtttttcagatcggcaacggtgacggtccagctgttatcgtcattacgctttagggcgcggacttcgctgctgagttgcagcgagaagttagatttcttctgtaaggaggcgatcaactggcgggtgatctcgccatagttcacatcagtgccaatttctgtgcgtgttgccgctactttctgttgcggatcgcgcccttccatcactaacggtgcccactctttgatctgcgcgtgatcttcagagtaacgcataccgcgaaacagcgagctttgttgcaacgcggcgtaacgggcgcgcaggaaattaacgttatcctcgccccagacaaagctcatatgcggaacggtattgataaatgaacgcggagtacgcagcacaccgcgctcgacctggtgcgcccagaactggcgggaaatctgaaatgcttcgttaatggcgactgctttttcaatactgatgctgccgtcggcattttgcggggtgtaattgagttccatcagtgcagaatgcccggttccggcgttgttccagccgttcgaactctcctgcgcgacaccttccaggcgctccaccatggtcatcgaccattcaggctccagctcgcgtaaataggtccccaacgtggcgctcataatgccgccgccaatcaacagtacatcagtttcctgctcctcggacgctttcgcttttgccgccatcgaaacggcattaagccccacggccatcgagaagagcatggcagtcacttttttcatcttgttaatgccttacttttagtcgctttattgcaggtgagatttgcgcggcatcaacggtaacacttaagtaacaacatttaaataatgtttataaattatattataattttagaaacattataatttcgttgattaattatagggttattagaaacgaaggtatttttagaatattgacctgccggcagcagtccgccaggtcagcgtcgtaatattatgccgtccgggcaacggcatcacgcgaagcagcatcgcgctcttcgcctgtcagctcgctaagttgcccgttgcgcatttccagcaggcggtcggcgtggataaagtaatgatcatcatgactgatggcgaaaatagttttacccatctcctgcatcagcggcagcagcacctgataaaactcacgacggaagtgtggatcctgatccgccgcccattcatccagcaggataatatcgcgttcttctgccagcgccagcaacagcgccacgcgttttttctgcccttttgataacttcaggttaacaatacgcccgttgcttaactcaagcttatgagccattttcagctgcgccagccacttctcaaccagttgcgggttagcgggttgcccctccggccccagcagttgatcaaatagccagacatcggtaaacactgccgaaaacagtttgcgataatcttccggttgttcgccgctgacaggtttgccatccagcaagatttcgccgctttgtggttggtacaagcccgtcagcaacatcgccaacgtcgattttccactaccgttgccaccaatcagaaacagcagttcaccacgtttgatggtgaggttaatcggcccaacggaaaacgcgttatcctgataagcaaacgtcacgttacgcagctccagcgtttgccagttgggaaaagcctgcgggcgcggaaactctgctttgaaaggcgcgagcgcgaatttgttcagcttgttaaacgccacctgcgccgtcagcagcgtcggtaatgcgccaaccgccgaaagcagcggcgtacgcaggaataacagcgtcaacgaataggtcgcggcaacgttggtatcagcccaaccgagactgttcgccatccagaacaccaggccgatagcgcccagcatcatgatgtttgaccagttcacggcactaagatggaaggtgtctgcgcggataatatgatggcgatactcttgcgcatcaggaatgtagaggttgttaaacacatactcggcgcgttcccggttcagagtcagctctttgcgcccttcgagtacggtttgaaaatccgtgtacagcttatcttcggtttcacgcagggtcgccatatgtttgtacacccgcgccaccagtataaaaccaccccagatggtgactgccatccagatagccgttaccagcaacattttgcccgacagcatccacaaatacgccgctgaaccgatagtgagaatgatcccctgcaccagttccggcagacgcacaaaagcaatggtgatattgcgcacatcgctggttaaccccgccagcaacgaagcgctaccaagttgttcaatgcgctcgacgtgggtatccagaatccgcttgataaattcactacgcagtcggtaaacgaagtgatgccccaaagtggtgagcgccagttgcgatccgagagtgactgccatcaacagcaacaataatcccagaaactccggcaacaccagcagactggtatccgccgtttcgataaggcgctgattgataaaagcaattaagccaatgcctaatgccgcactggcgaggcttagcgccatcacactgataaatggccagcgatactgccgccagacaagtacaagaagttccatgcagaaaacccggacaatgaattacagcccgcagtttaaacatcttcgcgcgcacagcaataataattcttatttttattcttttttacctgcctgacggaatgtcaggttgtagcggcagtcggtggtgagtggatgaaaccccgctttcaacggttgaataccgtgataaaacagccgcgattcaccgccccataccaccacatcgccatgttccagcaacaatctttttagcggatcatttcgtttcaggccgccaaattgaaaaatcgcgggtaagcccagagaaacagaaacaatcggcgcgcgcagatccggttcgtctttatcctgatgcagcgacagtttcgcgccaggagcgtagcggttgataagacaagcatctggctggaaatctggatagcccgccgccgtagccgcacgttgacataaattatgaaaactctgcggcatggcgggccacggtttatttgtttgcggatcaatgggcgaatagagataaccctgccgatgggtggtccagcccagacgcccgcagttggtcatcgccaccgacatggtatatccgcctggagtgaccatctggcgaaacggcgactggctggcaacgtcattaatatcgcggatcagttgctccgcagcgttaaaagcaaaacggtgcaaaatcaccgctccagccgccagtggttcttgccacggttcagcatcggcaaacagatccaacattacctctcctcattttcaacttcgcggcgcagcagttgcgctttgcgcgacacgccccagctgtaaccggaaagtgagccatcaccacggaccacccgatgacaaggtataacgatagcgagcttgttggcggcacaggcgctggcaacggcccgtaccgctttcggtttgccgatggcgttcgccagttgctgataactgacggtttcaccacaaggtatcgtgcgcagtgcctgccagacttgttgctgaaaagcagtgccgcgaatatccagcggtaacgtcagcggcgtatcgcgttgattgaggctggcgatcacttcacgcacatgttgctgaaacgtcagatcggcaggcgcgttgtcggcagcgggaaacatctgctgcaactcgctgattaatgtcgcatcatcatcgcccaacaatatcgcgcaaatcccccgctcgctttctgccaccaggcaacggcccagctcacaatcagccagcgcgtaacgcaccgccagattttcgccaccgtgacggaattgtttagccgtcatgcccagcgtttcatcggctttacggtagtaactgctgccgtcggggaatccggcactgagaatcgcctgagtcacgctctccccttttgccagagactcccgcaatcggcgagcacgccaggcctgctgccaggctttcggcgtcattccggtagtcgctttaaacaatctatgcaaatggaacggactcatcgccagctgttcggctaaggattccagcgttacaggcgtttcctgttccagcagtcggcaggcgtgggtgattttatcaaggcgatgttgttggggattggctttgtctggctgacaacgtttgcaggggcgaaagccagcggcaagcgcctcactggcatcggcatagaaagaaacgttttcccgcaaagcatgtctggcgcggcaagacggacggcaaaagatgcctgtggtgcgcacggcgaaaacgaattcgccgtcggcattcgggtcgcgggctaagacagattgccagcgttgatcgtcagttaagcatgtggcgtttttcataatcagctccctggttaaggatagcctttagtctgcccggtcaccatcacgcaaaaaccaacaatcttgcgctttaatttttttcgctgataaggaagcttttaaactgcggcgacatccaggttttaaagctatcgccctctttggtgatcatataaaccgccagcccttcccggcgaacgacttctttggctttctctggcccgagcaccattaagccagtatcccaggcgtcggcttccagcgccgtcggggcaatcaccgtcacggataccagattgtgttcgatgggacgcccggtttgcggatcgataacatgggaaaggcgtttgccgtccagttcgtaatagttacggtagctgccagaggtgctaatgccatgaccgttgatatccaccacggcctgaaccgcgttttctttatcggttggtttttgaatcgctacccgccacggctggccttcaccgttcatgccacggctgttcagcgcgccgcccaccgacaccagatagcgggaaatcccttcctgctccatcaagcgtgccagatgatccgccgcatagccttcgccgacagtggagagatcgacatataaatccggcaggtttttttgcagatattgctgatgcgactgattaatgaccgtcaggtgctgtaagccggttttggctttcatcgcatcgatctgttcctggctcggaatttgaaccggctgttgttccgggccaaagccccacagattcaccagcggcccgacggttatatccatcgcaccatcggtccttgcgccaatgcgcagcgaggtggtgacgatatcggccatcgcttcacttaccggccacggcgacaaactttgcgagtcgttaaagcgcatcagcgcggaatcttttttataggtcgaaagcagctgatcgtcggcgtccagctgggtctgaatcttttctttaagttcggcactgcgtttggcatcaatgcccgggatgctggcacgccagaaggtacccatggttttgccttcaagaacggtaacttcagtagcgtgggttttggcgggttgtggtttttgatcgcaaccaacaaagaagagcgcggcagccagcagtgccacgcgggtaaagcttatttccatacgtgattatcctcatgcgaacggtcgcaagagtacaccaaaaaactgtgtttgtacgctgaaaacaatgaaaaaagggcccgcaggccctttgttcgatataaatcgagattagaactggtaaaccagacccagagctacgatgtcatcagtgttgatgccagcagcgcgggtgaactggttgtcgtccagcaggttgattttgtagtcaacgtaggtggacatgtttttgttgaagtagtaggtagcaccaacatcaacatatttcaggatatcttcgtcgtcgtagttacgaccagcaacgacacccaggtttttacctttagactgcaggtatgctacagacggacgcagaccaaagtcgaactggtactgagcaacagcttcgaagttctgtgctttgttcgcccaacccagggaacctacgcgagttgcgttgtaggtctgggtgtactgagcagccaggtagatgttgttagcgtcgtatttcagaccaccagtgtaggtttcagcacggtcgccagtaccgatcaggccagtgttgttctgatcccaggtacgtttggagctggaaactgcagcaccaacgccgaagccttcgtaatcataagtgatagatccgccgacaccgtcgccgttctgacgcagagctttacgaccattgttggtgatgccatgaccagtgaaatccggatcattttcaccgcttacgctgccattctggccctggtactgaacagcaaagttcaggccgtcaaccagaccgaagaagtcggtgttacggtaggtcgcgaagccgttaccacgctgctgcatgaagttgtcagaaccgtaggtgtcgccaccgaattctggcagaacgtcggtccaggaagttacgtcgtaaacaacgccgtagttacgaccgtagtcgaaagaaccgatgtcctggaatttcagaccagcaaatgccacacgggtccaggagttgttttcgctttccggagcgttgccctggatctgatattcccactggccgtaaccagtcagttggtcagtaacctgagtttcgcctttgaaaccaagacgcatgtaggtctggtcgccatcttctgacttgttgtcagagaaatagtgcaggccgtctactttaccgtacagatctaatttgttgccgtctttattgtaaacttcagcagcgtttgctgcgcctgctaccagcagagctgggaccaggagggacagtactttaactttcatgttattaaccctctgttatatgcctttatttgcttttttatgccactgcatactgattaaccctcattaatcagtcggcaagtccattctccccaaaaatgcagaataatccaacacgaatatgatactaaaacttttaagatgtttcacttatcgctatagatgtttcaaaatgtaaatacaagggaactttttaagattattgcggaatggcgaaataagcacctaacatcaagcaatattaattcaaggttaaaatcaataacttattcttaagtatttgacagcactgaatgtcaaaacaaaaccttcactcgcaactagaatatctcctgctatcatcattaactttatttattaccgtcattcatttctgaatgtctgtttacccctatttcaaccggatgcctcgcatccggttttttttacccttctttacacacttttcattattctgtgctaccacagaaaaactataacgcttgttaactatttcacaaataattaatatcagcataatttccagcaatcttcgtttatttgcaattaatttcgttaggctttttgtaggttatttgtacagcaaaatagcgcttgtacatctatttcccccaatgcaggatgataaatatcactggagaatagagaatcatcaatcaggtaagagtctggaatttcacactgtaccctttatactgccctatcacttcgcgaagttttaacaggtcataaacacgaatgcgtcagaaagagacaacggccacgacccgcttttcactcctaccggggagcattacccgcttctttttactgttgatcattgtgttactggtgacgatgggtgtaatggtacaaagcgccgttaacgcctggctgaaagataaaagttaccagattgtcgacattacccacgcaatccaaaagcgcgtcgatacctggcgttacgtgacctggcagatctacgacaacattgccgcgacgatctccccctcctccggcgaaggtttacaagagacgcgactgaaacaggatgtctactatctggagaaaccacgccgcaaaacggaagccttaatctttggctctcacgacaactcaacgcttgagatgactcaacggatgtccacctatctggacacattgtggggcgcagaaaatgtaccgtggtcgatgtattacctgaatggtcaggataacagtctggtgctgatctcaaccctgcccctcaaagatctcacctccggatttaaagaatcgaccgtcagcgacattgttgattcacgtcgtgcagagatgttgcaacaggccaacgccctcgatgaacgcgaaagtttttctaacatgcgccgcctggcctggcagaacggtcattactttaccttgcgtaccacgttcaaccagccgggacatctggcaacggtcgtggcttttgatctgccgattaatgatttgatcccaccgggtatgccgctggacagtttccgccttgagccagacgcgacggcaacgggaaacaatgaaaatgagaaagaagggacggatagcgtcagtatccactttaacagtacgaagattgaaatctcctcggcactcaactctaccgatatgcgcctggtctggcaggttccttacggcaccttactgctggatacgttgcaaaacattctgctgccactgctgctgaacatcggtttgctggcgctggcgttatttggctataccacattccgccatttctccagccgcagtacagaaagcgtccccagcacggcggtcaataacgaattgcgcattttacgggcaattaatgaagagatagtctcactgctgccgctcggcctgctggttcacgatcaggaatcgaaccgcacagtcataagtaacaaaattgccaatcatttgctgccgcatttgaatctgcaaaacatcaccaccatggcggaacagcatcaggggattattcaggcgacgatcaataacgagctgtatgagatccgcatgttccgcagccaggttgcgccgcgcacacaaattttcattattcgcgatcaggatcgcgaagtgctggtaaacaagaaactcaagcaggcgcagcgtctgtatgagaaaaaccagcaggggcggatgacctttatgaaaaacattggcgatgcgctgaaagaacccgcacagtccctggcggagagcgcggctaaactcaacgccccggaaggcaaacaactggcgaatcaggcagatgtgctggtgcggctggtcgatgaaatacagttagcgaacatgcttgcggacgatagctggaaaagtgagacggagctgttctccgtgcaggatttaattgatgaagtagtgccttcagtgttgcctgccatcaagcgtaaaggtctgcaactgctgattaacaatcatctgaaagcacacgatatgcgccgcggcgatcgcgatgccttacgacgtattttgctactactgatgcaatatgccgtgacctcaacgcaattgggaaaaatcacccttgaggttgatcaggatgagtcctccgaagaccgcctgacgttccgcattctggacactggagaaggcgtaagcattcatgaaatggataatttgcacttcccgtttatcaaccagacccaaaacgatcgctatggcaaggcggacccgctggcattctggctgagcgatcaactggcgcgtaaactgggcggtcatttaaacatcaaaacgcgggatgggcttggtacacgctactctgtgcatatcaaaatgctcgcagctgacccggaagttgaagaggaagaagagcgattactggatgatgtctgcgtaatggtggatgttacttcggcagaaattcggaatattgtcactcgccagttagaaaattggggtgcaacctgtatcacacccgatgaaagattaattagtcaagattatgatatctttttaacggataatccgtctaatcttactgcctctggcttgcttttaagcgatgatgagtctggcgtacgggaaattgggcctggtcaattgtgcgtcaatttcaatatgagcaacgctatgcaggaagcggtcttacaattaattgaagtgcaactggcgcaggaagaggtgacagaatcgcctctgggcggagatgaaaatgcgcaactccatgccagcggctattatgcgctctttgtagacacagtaccggatgatgttaagaggctatatactgaagcagcaaccagtgactttgctgcgttagcccaaacggctcatcgtcttaaaggcgtatttgccatgctaaatctggtacccggcaagcagttatgtgaaacgctggaacatctgattcgtgagaaggatgttccaggaatagaaaaatacatcagcgacattgacagttatgtcaagagcttgctgtagcaaggtagcctattacatgaacaatatgaacgtaattattgccgatgaccatccgatagtcttgttcggtattcgcaaatcacttgagcaaattgagtgggtgaatgttgtcggcgaatttgaagactctacagcactgatcaacaacctgccgaaactggatgcgcatgtgttgattaccgatctctccatgcctggcgataagtacggcgatggcattaccttaatcaagtacatcaagcgccatttcccaagcctgtcgatcattgttctgaccatgaacaacaacccggcgattcttagtgcggtattggatctggatatcgaagggatcgtgctgaaacaaggtgcaccgaccgatctgccgaaagctctcgccgcgctgcagaaagggaaaaaatttaccccggaaagcgtttctcgcctgttggaaaaaatcagtgctggtggttacggtgacaagcgtctctcgccaaaagagagtgaagttctgcgcctgtttgcggaaggcttcctggtgaccgagatcgctaaaaagctgaaccgcagtatcaaaaccatcagtagccagaagaaatctgcgatgatgaagctgggtgtcgagaacgatattgccctgctgaattatctctcttcagtgacgttaagtccggcagataaagactaatcacctgtaggccagataagacgcgtcagtgtcttatctggcatttgcacggattgccggatgcggcataaacgccttatccgtcctacgattcccgcgatttcctgaccctctcggcatataccgtcagcgtctgttttatcacatccagcgttactggcttcgacaggcagctgtccataccggactccagacaccgctgcttctcttcagccaacgcattagcagttactccgattacaggcaacgtcagtcccaactgacgaatgcgttgcgtcaagcggtaaccatccatatttggcatattgacgtcgctaagcacgatatcaatatgattcttgttaagtacattaagcgcatcgacgccatcattcgcggttttacattgatagcccaacgatcccaactgatctgccagcagacgccggttaatcggatgatcatccacgaccagaatcatcatatcgtcattatcgctgaccgctttgtccgtcgacggcagagcgttagcaggatcgtcgctctccatctcgatcaaataaatacgcgccaacaatgccggtagctcatgcggagcagccacactgtgtacccactcccctggcgctttctccagcggaataccaatatggcgacgacagaaggtcactaccgctctgccctgccattttttactcactacctcgtcagtgattaacacatcttcgggagtcggttcctgcccttcgtatgttgtaacgacgatgccgctgcgctgcaaactggtttccaggaactgacagagcgacgcattgcggaccgccagccagcagcgtttaccactcaacccttccacgccttttttctgcggatactgagcgccgtacaacggaatacgcacggtaaactggctgcccattcccggttctgaatctaccgagatgtcgccgtccatcatgctgatcagtttttcacaaatcgccagacccagaccggtcccctggaagtttcgctgtacgcccgttccgacctggaagaagggatcaaacaagcgcacgacttctttcgccggaatccccacgccggtatcgcgaacacggatagagagataatcgccatcagcgcgaacatgcaaaactatacagccggtatcggtgaattttatggcgttactcaacaggttggagatgacctgctgtaaacgcatcgggtcgccatttaaggccactggcacatccggttcaataaagcagtacaagcctaactgcttgcgtaccaccagcggtaaatagttggcggtgatgtggttcatcacttcacgcggtgaaaactcacgcggttcgatcttcaactgttctgattcaattttcgagaaatcgagaatatcgctgataattttcaacaacaggctggaagagttgttcattgccgtcaccagacgatcgacgcctttcggtaactctttggtttgcaacagatccaggttaccgataatgccatacagcggcgttcgcagctcatgactgacggtggccaggaacatcgattttgactggctcgcctgttccgctgcttgtgccatctcctgcaacgactcttccatcttcacgcgcgaagaaacatccaccagcacacaaatggccacgttttcattacgatagcgcgaatggacgaagctgatttgcagattggtattgttgctggtcaggacatcaacaaaattgacctgctgcccacagataatttgtgtcagccgttggcggtcctcatgcgtaagcatattgagataggtatgcgccagttcgttacttaaaatattgacgccatcagcggtacgcaaaatgcagatacccactggcgcggaggcgacaatcttgcgattaaattgctcatgttcttccagtcgcagggcgtcgctttccgccggaatgaaaatacgccgctcgtacatccgcgcgagagtaaacaatgcagctccggcaagcacattcagcaaaattgcgttaaggatcaacatgcgaatgcgttccagcaccttatcaactggcactgaataaacgatgcttagcgatgagggtggcagatttttcttcagcaccagttcccggaacccttccgtatagccaaaccaggagcgttcctgcatccagcgaggatcgcccttaattttgctttctggtccggtaagcgaaatcagggtatgaccattttcatcaagaatggtaacccccatcggcaacgtaccaggtaagaaaaagttctccatccggatggtttgctcgacacccaaaagcgcctgcaaccggttcgccagataaactggcgtcaacgcgtaaaaatacccgacgccagggcgcggaccttcgctgatccagtagaggttactgccgctatcatcttgtggtgcatttcgatatttattgatgcgttcatgcaacgctttcaacgcggtatcgcgttccactggcatatcacgcagaccgaaattggccatgcagaggttatcgctgccgattaaaaatacccggtttagatcgtaagccgcagaaaaattatcgcgccagtagcgcataaaccacgccaatgactccagagaacctcgccaggtgttactcattgcggaacaatcagagtcagcaaatagcggttcaaacgcaggcacatccgtctgcgtttctcgtccacgcggggaaagcacaccgttttctgccgataagcgattttcagctatgtacttcagctctttcatcacatcagaggtgcgttgaataaagcgctgagcctgatcggaactcagattaaattcctgacgaatttccgattctcgctgatgtaacgcattaacgatgtaaaaaacggatgaaaaagcaatcaacagccagagcactaacgccaatgctctgaacatgtagcgcgaggctttcagggttgtacgaaaagaagcaaggtatttcaaaggggcgaagctccgcctcaggtgaccgatggagtgtggttaaggtagcggtaaaagcgtgttaccgcaatgttctctcttctctggaatatgatacaccgccgagaaatcatcaccttaacctctgataatcgtcatataccggacaagactagtggatttcagcatgcattatatgaagtggatttatccacgccgcttacgcaatcaaatgatcctgatggcaatcctgatggtcattgtcccaacgcttactattggttatatcgtagaaacggaaggacgttcagcagtcttatctgaaaaagagaaaaaactttctgccgtggtcaacctgcttaatcaggcgctaggcaatcgctacgatctctacatcgacttaccgcgtgaggagcgtatccgcgcattaaatgcagaacttgcccccattaccgaaaatatcactcacgccttccctggcatcggcgctggttattacaacaaaacgctggatgcgataatcacctacgcgccttcagcgctatatcagaataatgtgggcgttaccattgccgcagatcaccctggtcgcgaagtcatgcgtacaaatacccctttggtttattcaggcaggcaggtgcgcggcgatattttgaattcaatgattcccattgagcgtaatggtgaaatcctcggctatatctgggccaatgaattaaccgaagatattcgccgccaggcctggaaaatggatgtgaggattatcattgtgctcaccgccggtttgctgataagcctgctgttgattgtccttttctcccgtcgcctgagcgccaatatagatatcatcaccgatggcctctcgactctggcacaaaatattcccactcgattaccacaattgcccggtgaaatggggcaaatcagtcagagtgttaacaacctcgcccaggcactgcgtgaaacgcgaacacttaacgatctgattattgaaaacgctgccgatggcgtcattgccattgaccgccagggtgatgtaaccaccatgaacccagcagcagaagtcatcactggctatcaacgtcatgaactggtagggcagccttactccatgttgttcgacaatactcagttctacagtccagtactggatacgctggaacatggcaccgaacatgtagcactggagatcagttttccaggccgtgaccgcaccattgaactcagtgtcacgaccagtcgtattcataacacgcacggtgaaatgataggtgctttggtgattttctctgatttaactgcccgcaaagaaacccagcgccgcatggcgcaagcagaacgcctcgccacactgggtgagctgatggctggcgtggcgcatgaagtacgtaatccgctaacagctattcgtggttatgtacagatcttgcaccaacaaacccgtgacccaatacatcaggaatatctgtccgtagtactcaaagaaatcgattcaattaacaaagttattcagcaattgctcgaattttcacgtccacgccacagtcaatggcaacaagtcagcctcaatgcattggttgaagaaactctggtactggtacaaaccgccggcgtacaagcgcgggtcgacttcataagcgaactggataatgaattaagcccgattaacgccgatcgtgaactgctcaaacaggtactactgaatatcctgatcaatgccgtccaggctatcagtgcacgagggaaaattcgcattcgaacctggcagtatagcgactcgcaacaggccatttcgatagaggacaacggcagtggcattgatctctcgctgcaaaaaaagatcttcgatccctttttcactaccaaagccccaggaaccgggcttggtctggcgttaagtcaacgcatcattaatgcccatcagggtgatattcgcgtcgccagtttgccgggctacggcgcaaccttcacgcttattttaccgatcaacccgcagggaaatcagactgtatgactgctattaatcgcatccttattgtggatgatgaagataatgttcgccgtatgctgagcaccgcttttgcactacaaggattcgaaacacattgtgcgaacaacgggcgcacagcattacacctgtttgccgatattcaccctgacgtggtgttgatggatatccgcatgccagagatggacggcatcaaggcactaaaggagatgcgcagccatgagacccggacacccgttattctgatgacggcctatgctgaagtggaaaccgccgtcgaagcactacgctgcggagccttcgactatgttatcaaaccgtttgatctcgatgagttgaatttaatcgttcagcgcgctttacaactccagtcaatgaaaaaagagatccgtcatctgcaccaggcactgagcaccagctggcaatgggggcacattctcaccaacagcccggcgatgatggacatctgcaaagacaccgccaaaattgccctttctcaggccagcgtcttgattagcggtgaaagcggcaccgggaaagagttgattgccagagcgattcactacaattcgcggcgggcaaaggggccgttcattaaagtcaactgcgcggcgctgccggaatcgttgctcgaaagtgaactgtttggtcatgaaaaaggtgcatttactggtgcacaaaccttgcgtcagggattatttgaacgtgccaacgaaggtactttgctcctcgacgaaattggcgaaatgccgctggtactgcaagccaaattactacgcattctgcaggaacgggaatttgaacggattggcggccatcagaccataaaagttgatatccgcatcattgctgccaccaaccgcgacttgcaggcaatggtgaaagaaggcaccttccgtgaagatctcttttatcgccttaacgttattcatttaatactgccgcctctgcgcgatcgccgggaagatatttccctgttagctaatcactttttgcaaaaattcagtagtgagaatcagcgcgatattatcgacatcgatccgatggcaatgtcactgcttaccgcctggtcatggccaggaaatattcgagagctttccaacgttattgaacgcgccgtcgtgatgaattcaggcccgatcattttttctgaggatcttccgccgcagattcgtcagccagtctgtaatgctggtgaagcaaaaacagcccctgtcggtgagcgtaatttaaaagaggaaattaaacgcgtcgaaaaacgcatcattatggaagtgctggaacaacaagaaggaaaccgaacccgcactgctttaatgctgggcatcagtcgccgtgcattgatgtataaactccaggaatacggtatcgatccggcggatgtataacgccaaaacttgctatgcagaaatttgcacagtgcgcaattttctgcatagccgctcattctccttatgaatccccatctaatttatccttttctattcaattagttaaataacaacattcaataatctcattctggcactccccttgctattccctgactgtacccacaacggtgtatgcaagagggataaaaaatgaaaacaaaattgatgacattacaagacgccaccggcttctttcgtgacggcatgaccatcatggtgggcggatttatggggattggcactccatcccgcctggttgaagcattactggaatctggtgttcgcgacctgacattgatagccaatgataccgcgtttgttgataccggcatcggtccgctcatcgtcaatggtcgagtccgcaaagtgattgcttcacatatcggcaccaacccggaaacaggtcggcgcatgatatctggtgagatggacgtcgttctggtgccgcaaggtacgctaatcgagcaaattcgctgtggcggagctggacttggtggttttctcaccccaactggtgtcggcaccgtcgtagaggaaggcaaacagacactgacactcgacggtaaaacctggctgctcgaacgcccgctgcgcgccgacctggcgctaattcgcgctcatcgttgcgacacacttggcaacctgacctatcaccttagcgcccgcaactttaaccccctgatagcccttgcggctgatatcacgctggtagagccggatgaactggtcgaaaccggcgagctgcaacctgaccatattgtcacccctggtgccgttatcgaccacatcatcgtttcacaggagagcaaataatggatgcgaaacaacgtattgcgcgccgtgtggcgcaagagcttcgtgatggtgacatcgttaacttagggatcggtttacccacaatggtcgccaattatttaccagagggtattcatatcactctgcaatcggaaaacggcttcctcggtttaggcccggtcacaacagcgcatcccgatctggtgaacgctggcggacaaccgtgcggcattttacccggtgcagccatgtttgatagcgccatgtcatttgcgctaatccgtggcggtcatattgatgcctgcgtgctcggcggtttgcaagtagacgaagaagcaaacctcgcgaactgggtagtgcctgggaaaatggtgcccggtatggggggcgcgatggatctggtgaccgggtcgcgcaaagtgatcatcgccatggaacattgcgccaaagatggttcagcaaaaattttgcgccgctgcaccatgccactcactgcgcaacatgcggtgcatatgctggttactgaactggctgtctttcgttttattgacggcaaaatgtggctcaccgaaattgccgacgggtgtgatttagccaccgtgcgtgccaaaacagaagctcggtttgaagtagctgccgatctgaatacgcaacggggtgatttatgattggtcgcatatcgcgttttatgacgcgttttgtcagccggtggcttcccgatccactgatctttgccatgttgctgacattgctaacattcgtgatcgcgctttggttaacaccacaaacgccgatcagcatggtgaaaatgtggggtgacggtttctggaacttgctggcgtttggtatgcagatggcgcttatcatcgttaccggtcatgcccttgccagctccgctccggtgaaaagtttgctgcgtactgccgcctctgccgcaaagacgcccgtacagggcgtcatgctggttactttcttcggttcagttgcttgtgtcatcaactggggatttggtttggttgtcggtgcaatgttcgcccgtgaagtcgcccggcgagtacccggttctgattatccgttgctcattgcctgcgcctacattggttttctcacctggggtggcggtttctctggctcaatgcctctgttggctgcaacaccgggcaacccggttgagcatatcgccgggctgatcccggtgggcgatactctgttcagtggttttaatattttcatcactgtggcgttgattgtggtgatgccatttatcacccgcatgatgatgccaaaaccgtctgacgtggtgagtatcgatccgaaactactcatggaagaggctgattttcaaaagcaactaccgaaagatgctccaccgtccgagcgactggaagaaagccgcattctgacgttgatcatcggcgcactcggtatcgcttacctggcgatgtacttcagcgaacatggcttcaacatcaccatcaataccgtcaacctgatgtttatgattgcgggtctgctgctacataaaacgccaatggcttatatgcgtgctatcagcgcggcagcacgcagtaccgccggtattctggtgcaattccccttctacgcggggatccaactgatgatggagcactccggtctgggcggactcattaccgaattcttcatcaatgttgcgaacaaagacaccttcccggtcatgaccttttttagttctgcactgattaacttcgccgttccgtctggcggcgggcactgggttattcaggggccgttcgtgatgcccgcagcccaggcgctgggcgctgatctcggtaaatcggtaatggcgatcgcctacggcgagcaatggatgaacatggcacaaccgttctgggcgctgccagcactggcaatcgccggactcggtgtccgcgacatcatgggctattgcatcactgccctgctcttctccggcgtcattttcgtcattggtttaacgctgttctgacggcaaccctacaaacagaaggaatataaaatgaaaaattgtgtcatcgtcagtgcggtacgtactgctatcggtagttttaacggttcactcgcgtccaccagcgccatcgacctgggggcgacagtaattaaagccgccattgaacgtgcaaaaatcgattcactacacgttgatgaagtgattatgggtaacgtgttgcaagccggactggggcaaaatccggcacgtcaggcgctgctaaaaagcggactggctgaaacggtgtgcggattcacggtcaacaaagtgtgcggttcaggtctgaaaagcgtggcgcttgctgcacaggcgattcaggcaggtcaggcacagagcattgtggcggggggtatggaaaatatgagtttagcgccctacttactcgatgcaaaagcacgctctggttatcgtcttggagacggacaggtttatgacgtaatcctgcgcgatggcctgatgtgcgccacccatggttatcatatggggattaccgccgaaaacgtggctaaagagtacggaattacccgtgaaatgcaggatgaactggcgctacattcacagcgtaaagctgcagccgcaattgagtccggtgcttttacagccgaaatcgtcccggtaaatattgtcacccggaagaaaaccctcgtcttcagtcaagacgaattcccgaaagtggattctacggctgaagcgttaggcgcattgcgcccggccttcgataaagcaggaacagtcaccgccgggaacgcgtctggcattaacgacggtgctgccgctctggtgattatggatgaatctgcggcgctggcagcaggccttacccccctggctcgcattaaaagttatgccagcggtggcgtgccccccgcattgatgggtatggggccagtacctgccacgcaaaaagcgttacaactggcggggctgcaactggcggatattgatctcattgaggctaatgaagcatttgctgcacagttccttgccgttgggaaaaccctgggctttgatcctgagaaagtgaatgtcaacggcggggccatcgcgctggggcatcctatcggtgccagtggtgctcgtattctggtcacactattacatgcaatgcaggcacgcgataaaacgctggggctggcaacactgtgcattggtggcggccagggaattgcgatggtgattgagcggttgaattaaccaataaaaacgcccgatagcgaaagttatcgggcgttttcttgaacatcgacggcgaaggtaaccccattaatcaccagtcaaaacttttcaccagcgtcagctcgccagcattacgcatcggtacaataaatgtttcctgtttctcattgaccgatccttcatcggtgatcagcgtcagttgggcggtggttaattccgtttcgctgcgtccgccatagtagttgatatacacctgataacggccgtgaactggcgctggcatggcgaaaatctcggggccgtaccctgtcgtgacatccatatccagtgcaccactgtttttcagcacggtgttaccgtaccaggcatgttcaccgtcaggcgtaacgacatgaagatcgaggtcggtattgtccgtatcccacgagagaaccagccgtaaacgtgcgcgaatcgccccagcacccggcgttgagtaaaactgcattttttgtcggctttgcccctctgggctgatgacctgcacgctgttgctgccttcagtgaaaatataagggcgtgcaaaagaaccatctgattcaattctctgcggcatactggcaccgttgaccaccagccggccctgctgaactttacccgccgcagcataattctttattttgccgcggatctgcgctgagatattttgatcatctgccatgttgacggacgacgccgggtaattgatcgtttgtgaaaaactggcatcttcaccctctgccggatgccagccagagagcggtgcatcaatctcgacttcctgcacaccttcactgtgagcgacaggcgaaagcgccaccagtaacaacggaagaaaaatctttcgcatagcattagtccattaataattgtcgggtcagcgtttcgatatagttctcatcaagcccggtgggataaccatcaaaggccaggtgcagatactcatgggttaaatccagccgatcctgaagcgtaaagaaattacgaataaacagccgtttctgctgccgatcggtataggggaaacctgagactaaacgacagaccgcaaacacgtctggttcgttgtatcccgtctcaccttgtaatatacgccgccactgcggcatttttttcgccagccaggctttcgctttgggtaataactggcaggttgagcgtggcgctccccagcggctaaggttgttgtcgggataagcaaacgcaagtatctgatcataacgctctccctgccccgcctgggcagtagcgtgccgccaggaaagcgtcccttcggtaacccggctgccatgataatgaaccggatcgcccgcatagatgagatcctgcgtccaggcggtcatcgtccgcgcgcctacagtggctggcgaagctgaaacgcgctgggtagcgctactgtccgggatgctcaggcaatcaccatcgcgatcggcgttttgctgtaaatacgtgcgaatcgccacggtcatggctttcgctgcctcaggaggcgtacttttcgcctcgcgatccagaactctggcaacgtactcttcacgatcgagatgcgactgtaatttcagtttgccctttaccgtcagtaacgttgtctcaccgtggctgacaaatgtcatgtggttaccattggcaaacgtcacacgatagcgcccattgagcacgcctggtttgaatgccgtcgtactcttttcctcagtaactttcttcagcggataacgagcaaacagatccaccagcacacattgcccactggcaacttgcgtcggcactggcaaaacccgattaagcgccgtcgcataacgggtcagtaccgttttactggtgccactgccagtagcccacagcggtgtaccatcggttaaccagccagcaaaaccaccctgacggatttcctgcttatcatcggcaaaccagctccaggttttcacccgtacccgactaccgagcatggatgcgacaccgattttcgcctcgtccagcaccacatccagtaagacttcctgagctttgttttgcgcgggtaacgtcgctaaagaatcaagcagcgatttaaccgttaccgaggtttctggcttcagcgtagtaagagacgctaaccacgcaggtgcctgacgctgttgccagtattgcccccacacatctgcgccaatatgcaaccgctgcggcgcaaaatagagtccacaggagcgtaccagcgcggtatcgcgcgttatgctctccccagcctgacaacaataaacctcttccggggagtttccgcgacactggtagggctgctccggttgatgggtatcctccagccaggcgtaaacatacagtttccacaaactccctaatggcgtggtgagcgtgtcaggtaatgccgagactttggtcacgcctgatgacgacagctgatacagttgatcgtgttgcgcgccccgcagcgccagttgtaacggcgtctcctccgcaagcgttggcagagtaaccaacgccaatagccagacgattctgcgccagttcacttatttcacctgcatcccggtccattcactccctgccgcaacactttgctgtgcaggtgcataggaacgcacataacgagcaggaggcagaacgaattgccctttttgcgagaagcgcagcaaatggcggaaagtgaccgttcccgtcagttctttcaccggcaccatataggccagttcgcccatttcattacgcgctttttccagcaattgcccctgctgttttccagcgttaggtttattgaccgaaatgccccacgttgtccgctcaacgtcagcccccggcggcagcggtacttccacctgaccatagcgcagaacggcatcctgctcgctggtaagcgtaatttcatcgagatacagcgcatcgctgtcaatctcattgctggtcaccggctgcagagtaaagctcatctcttcttcaccggggataagccgatacaactggcgttcaacggtcaccggaatgttactttgttgagccgtttttgccggttcacgccagcggacctgcacattttgcggcgacaattcatcaccaaaagagagaatgtccggcacgccctgaccaacccaacgccagtattcgcctcctccggttaacttatgtttggcccatgcgcccgcaggcgcaggcaacacaactggaggcattgtcgccatatatttcgccagccagttcatggccaacgcgcgctcaatggtggattgctcagcggttaaaccacttaaaatagcggccgcctgggtagcgtcgcctccactattgagcagcacaaccgtgtgcgccagcggttggttgctgtttgctgctttatcccacgcatattgctgaacctgtggcatcacagtggacttcaactgcgcttttttcagcaacgtcatggttaagacgtttgccaccgcatctgccagtggagattcaggtgtatcgaggatcatgctgtcattgatatcgctggtgtcttcctcagagaaatcttcagttttagttccgcgccgggcgatagcttcatccaaccctttcaacaacgttttgcacggcagattcatctcctgtgcccacgccagcaccagcgcccgatgcaataacggcatgttgtccgcctgctcggcataactgtcgagcatatgttgccagtattccggttgctgcgttacgccgagcgcctggctggcctgccagtcggcgtaccatgcccatgccgtgaggaaggcgtcgccattgccatcttcaccccaccaggtaaagcgcgctccgggccccgccagttgcatcagccgcagacggttatcctgaatcatctgacgaatgtcgttagcggcggcactttgatgatcggcaagcgaacgccaggcgagactgagcgggatcagacggctaccggtgttgatcacgccaccccacggttcatcgactaacgcatcaagattgttacggaaaatctcctgcggcgtttcgctactttgtagccggatattgctcgcctgctcgggcaacatcagcgcattatcgccaccgccgagcatgacatttttctgttgttcaacgggccagctgttatccacaaaagacagttttgtgctaatgctgtcctgtacttgcccattttgttgcagttctgcacttaacaagccagattgctgaatattctgcgtcagcgaaatataattcgcccctttgtgcagcgtcagcgtctggcgcatctcagcacctgcaaatttagtcaccagcgccaccggttcgttatcctgctgactgaagataaacagtcctgccgccggtttgtcacccatgcgatacaccgttggcatactccatttcatgtagagacttttttccgaacgcagataagcacgcccctgcccgaccagcccgtcgccgttcatcccacgcgcggtgatgcgccagcgggttaacgaatcaggcatcaggaacgtgaaatacgctttgccttgtttatcggttgtgagtgacggcatccaggccgcggtatccacctcttcacgccgtggacgttcaagcatttttactcgccgctcgctgcggttagtcgcgccaggcgcaaccggctcgctggagagcgcctgatcgtagctgataaatgacaggctggagctggtacgcacattgttacgccccagcggatagaaaaatttgccgatattcggcgcgatttccggttgcagcgcgtagatcatttcatcgaccacgcctaccgttaactgcgcagaaacaggtttacctttcagcgacgaggttaattcgacattgaccagttcaccaggctggtaatgggttttgtccgttttcacccggatatccagctggggaacggcaactttaatcccggcgttctgaaaactgtactgaccgttacgggtatacagcaccgaaaaagtgatgttaggcgcaaaggaattgctcaccggtacgcgggcttcatactgggtatcgtttaaacgttgtagcgttagccagtttgccggatgcgatagcagcgactgctgttccacgcgatcgcgttccagcgtcaataatgcttcatcaattggctccgggaaggtaatcagcatcttcgcggtttcgccaggctggtacagcgttttatctgccacgatatctaccgtaccagtatgcgacgtgctgcccttaccgctgactgcatggcttaacccggcgagaattaagccgtctttatcgcgtaatgtcagattgtagttgccaggtttagcgaaattgacggtaaaggatttgccgcctgacggtagctctccgctgtggctcgtgcggtcttcgagacgcaaccattcatacgtaacaggaacctgttttgaagattccagcgcggcataacggaacacaaccagctcgccgctattactgtattgtgcggcggtacttaaagagtaatgcgccaggccacgttcaatgaggatctctttggtggtggtaactcgatacgccgcgccgtcactggcggagacggttaacaaataacggctcggtttatcggcggcggggagattcaacgccacatgaccattatcgtcggaaaccgtttcactgccttccagcgacaccgggaaacgtcctgcataacgcaaatcgttaccaaccattgataattgctgagcgcgcaaacttaactgcacgcgggcattttttaccggctcgccatccgggtagagcagttgcagtttgccgctgaccgcttcgccagttttgaactcttttttatcgagagctaaaccaatctcaaaatggggtttgatgtagtttgccacgcgaaaactgctgctatagacctgtttgcggtaagcaagacgtaactcataacctccggcgacggcattttctggcaggcggaaactcccctgcccgccattacgcgcatccagcgtgacattgacggtttgcaacagactgccgttggcgtccagcaccgaaagcttcgccggtgcgctgacgatgggggatgaatgcaacggatcgtggaactcgcggcccatcactttaacatcgacacgatcgcctgcgcgatatagcgggcgatcggtaaagatatacaagcgggtgttgtagatttcgctttcgtagaaaaagttctcggagacaaaaacgccgccttcagcatccttacccagaatatatgaacgttctggcgatatatgttgtaactgcaaggtaccgctgccatcggtcacaccgcgggtcatcacgccaagaccgtcagtccacaagatctctgagccgggcttcgcttcaccctgttttttccccgcggtccacaccagaagctcgttacctgacactttgctaagcgccacggtatcggaaacaaacaccaccgtcgtcgcccgatacccacccaccatcgcctcgacgaggtacagtcccggctcttgtttgccgagaggaatatagatgttgcccggctgcggcgaaatgaaattgctggatgcgccttccagttttaccccttgttgcggctcgaccggtttagcctgccataatgggtaacggaactgttccactagtggatattttttcagcggtgaaaactggttgttctgtacataacgggaaggtttaataatggcattaccgagctgtaattcgggtaacgcctgagtcacattctgccgtgactgagaagagaaagtacgctgcatcacgcggcgagatttgccgtaccagttatcccacagccaggtcagcgtattgttcagcccgtcgcccagatattgcgattgcaccacaatgcgatgcaggtttttctgctggcgcaaaaatgccatcgggtcaggaatacgatacaggcgaacgtccacgccgccgtactcttccatctgatagcgccgataatcacgccccggcgcttccagtcgcactttcgcctcttcactgctgctaaaactgctgtcagcaagcaaaaagaatgttcccccggcaggcggcgcatagttactggaaagaagcgaatcatcagcattagcaagccctgttcccacaagagacagggacaagcacgctgctatcgcgccagaaaatttaaacgataaatgccaatgaaattgggattggaatcgttgggtatccatcgggtgtccttccatgtcataagttgttgcagactgactgcgcgcattccgttgtcagttttcgtggcgcttccggtgtggtagatgatgtaacgccccatccagaccattaagtgctgggcatcgccctgatcgaaaaaaatcatatcgccaggcagtgcctggtttatgtcctggccaataaactggctgttgtactgaatcaaattaatcgcggtcacataggggccggttttcccattcccctgattccagttttgcgccagttgacgctgttcaggtgttagcgtcatctctggcggcaaatactggttagataaaccgttactttttagccatttactgtcgtgaactttcagcgcctcgttcgccgcaaatcgcaccaggcccgcgcaatcctgttgataccagcgtgggcttggcccctggcggagctgttcctgtgcaatgcgcacaaaccacgcgcgaaacagcccggattgttcgacatttagcatttcactatgggcaacaacacaatacagccagcaaatcagcaccagcagcccgtgtctcatagcggttgccaggttatgggtagccactgccaggcggcaccgggttccatctgggccagcttcatgacataacgcggttgttgagataaagcgtccagcttcggcattaataaagtttgtgcggcgttataaaaaaccggttcgagattcttcggcagactggtcagcgtttcgttacgcagcagtttcgccattccttgtggattgatatagagcggaacgatgccatcagtgggtattacatccaccattgccgggcgggttttattcagtgcttgcagggcgttattaaccagcgtgtcatcgagggagaaaagcagcgttttgttttgcatcgccagcgacacgcggaaaaaataatccgacattaattgatcgggttgcgccgcctgcgctttcggatactgaccgtatcgggaactcacttcgcgacgccagatttgcgcttcgccctgctgagtctggcttaccggcaaaacaccttctggcgctttgctttcgtgcgcaccaatattttgcgtaaacagtttccctggcaattgcgcctgttcggcagtgccatcaaactgaccaacaaatagcggggtttgtaattttgagtcttcataccagcacagcccggcgccaccgtctaacgccccattcagcttgtcgttttcctggctgatgtgcgaaagcatctcttcggcaataccgtgtgaatacggcaccgccacacagaagctggctccggcaggcatactgttccataccggcgtaaaatcgaaactggcatctacgctggcggattcatcgtttaacgccagaaaactgtgccagccgtcgttacccatttcgaagcgcacgccagcaaaagaaggcattaatcgctggtagccaaaccccagcaacctggcgctgactacgatgcgctggcgtactggcgttttttcggcagtacgcgcttccaggccaaagcgggtttcccagcgttttttaccactcaacaaatcacttgcgatcgccgtagcttcggtatcctgttggtcatctttaaatagcatatccgaactggaaaacgccaatattttgtcctgataagtcgcaaacatcaggacgttattgccgttatagcgcaactgataaacaggaatagtttcactatttatcttgatgctactaatttccgtcttgcttaactggctgtcgctggtagcggcaaacaacaatggctccagcagtttgcttaaaccactgcgctggatcagcaccatgtaatgtgaaagatggccttgtttatcgtgccatagcgccgcctgcgcaggctgatctaagagtgacgaaaagagcttatctttcagcgtgagatcgtgttcatagacaatgcggcgaatgctgccttcaatgcccagacgatcggcatgattctgataatagaaaacgaaatcttcgctcagaacatcgtggagaaacggaatggtaaggagatcgttgggaagctggctcagagagtcgctgtcgagaaagaggtccggctcattgagatcgatttgcagattgttgtgcaccaccagtggcgacaacgttttttctggcccactgccagagtattgtaatgcccatacgccagcggatagcagcgctattgccccaaaaccaacaaggccataaaaccgccagcctttcgcctttttttcaccactcattgccacattccttgtgtatagccagccattttttacgggcacagccaaactttaccgcgccctaatacgacaaaagcccagactttacagcctggacttttcaattcaaaaaagggagatggctcccttttggcatgaagcgatgaaattattcttcttctggctcgtcgtcaacgtccacttccggagcgatttcatcgtccccttccgcggcactgccgtcgatggtatccagatcttcctcgtcaaccggttcagcaacacgttgcagacccaccacgttttcatcttccgaagtacggataaggattacgccctgggtgttacggcctacgatgctgatttccgaaacgcgagtacgtaccagcgtaccggcatcggtgatcatcatgatctggtcgcagtcatctacctgcaccgcgccaaccactaaaccgttacgttcggtaaccttgatggagataacccctttcgtcgcacgcgacttggttgggtattccgccactgcggtacgtttaccataaccgttctgcgttgcggtgaggattgcgccatcgccacgaggcacgatcagagagacgactttatcgccttcgcctaaacgaataccacgaacaccggtggtgttgcagcccatcgcacggacagaagactctttaaagcgcaccactttaccttcagcggagaacagcattacttcgtcttcgccgctggtcaggtcaacgccgatcagctcatcgccttcaaccagtttgatcgccactttaccggcggtacgcagacggttgaactcggtgaggacggttttcttcacagtaccgttagcggtcgccatgaagactttcacgccttcttcaaactcggtcaccggcaggatcgcggtgatacgttcgtcctgttccagcggcagcagattgacgatcggacgaccacgtgcgccacgagtagcttctggtaactggtagaccttcatcgaatagacgcggccacggctggagaagcacagaatatgatcgtgagtgttcgccaccagcagtcggtcgataaagtcttcttctttaatacgtgcggcagatttacctttcccgccacgacgctgcgcttcgtattcagaaagcggctgatacttcacgtaaccctggtgagaaagcgtgaccaccacatcttcctgggtgatcagatcttccaggttgatgtcggcgctgttagcggtgatttcggtacgacgtttgtcaccgaactgttcacgaaccaactccagctcttcacggatcacttccatcagacgatcggcgctaccaagaatacgcaacagttccgcaatctgatccagcagctctttgtattcgtcgagcagtttttcgtgctcaaggccggtcagtttctgcagacgcagatccagaatcgcctgagcttgctgttcggtcaggtagtacagaccatcacgcacgccgaactctggctccagccattccggacgcgcagcatcgtcgcccgcacgttccagcatcgcagcaacgttgcccagctgccacggatttgcaaccagcgcggttttcgcttctgcaggcgtcggcgcatgacggatcagttcgatgatcgggtcgatgttcgccagcgccacggctaatgcttcaaggatatgagcacgatcgcgagctttacgcagttcgaaaatagtacgacgggtcactacttcacggcggtgacgaacaaacgccgcgatgatatctttcaggttcatgatcttcggctgaccatggtgcaatgccaccatgttgataccgaaagaaacctgcagctgggtctgggagtagaggttgttgagcacaacttcaccgaccgcatcgcgtttcacttcaatcacgatacgcataccgtctttgtcagactcgtcacgcagcgcgctgatgccttccacgcgtttttcttttaccagttccgcaattttttcgatcaggcgcgctttgttcacctgatacggaatttcgtggacgataatggtttcacgtccggttttggcgtcaacttctacttcggcacgggcgcggatatataccttgccgcgaccggtacggtaagcttcttcaataccgcgacgaccgttaatgattgccgccgtcgggaagtccggccccgggatgtgttccatcagcccttcaatgctgatgtcttcatcatcgatatacgccagacaaccgttgatgacttccgtcaggttgtgcggcgggatgttggttgccatacctacggcgataccggaagaaccgttcaccagcaggttaggaattttggttggcatgacgtccggaattttttccgtgccgtcatagttatcaacgaaatcgaccgtctctttttcgagatcggccatcagttcatgggcaattttcgccagacggatttccgtataacgcattgccgccgcagagtcgccgtcgatggaaccgaagttaccctgaccgtctaccagcatgtaacgcagcgagaatggctgcgccatacggacgatcgtgtcataaaccgccgagtcaccatggggatggtatttaccgattacgtcaccaacgacacgggcagattttttataggctttgttccagtcattgcctagtacgttcatggcgtaaagtacgcgacggtgtaccggcttcaggccatctcggacatctggcagcgcacggccaacaatgaccgacatcgcataatccagataggagctcttcagctcttcctcaatgttgaccggtgtaatttctctcgcaaggtcgctcatctaaccgctatccctctactgtatcccggattcaaaggtcgcaaattataacacagccgcgcagtttgaggtaaacctatacgctttattcacatccaatgcctgatatactcgtttgtcttgccaattacggagtagaagtgccaatgaatgccgaaaaatcgccggtaaaccacaacgtagaccacaaagagatcgctaaatttgaagccgtcgcctcccgctggtgggatcttgaaggtgagttcaaaccgctgcaccgcattaacccgctgcgtctgggctatattgccgagcgtgctggcggtttatttggcaaaaaggtgctcgatgtcggttgtggcggcggcattctggccgagagtatggcgcgggagggcgcgacggtgaccggtctggatatgggctttgagccattgcaggtggcaaaactgcacgcactggaaagcggcattcaggtggattacgtgcaggaaaccgtggaagagcacgcggcaaaacatgccggacagtatgacgtggtgacctgtatggagatgctggagcacgtccccgatcctcagtcagtggtcagagcctgtgcgcaactggtgaaaccgggcggcgatgtctttttctcgacgcttaaccgcaacggcaagtcatggctgatggcggtggttggtgcggaatatattttgcgcatggtgcctaaaggtacacatgatgtgaagaagtttattaaaccggcagaattgctgggctgggtggatcagaccagtcttaaagaacggcatatgaccgggctgcattacaaccctatcactaattcctttaagctcggccccggcgtggatgtgaactatatgctgcacacgcagaataagtgaggttgttgtttggattcatccggcaaccgagccaagcctgatgcggcgcttgccgcgtcttatcaggcctacaaatgctccccgtaggccagataaggcgtttacgccgcatccggcaacagtgccggtcagacagcgattaccatttcactgtcatcgacaaaaaccctgccgtctgggcaaaatcatcactccctttctgccacgccacgctaccacgcagcgaaactcgctgactgatattgcccgttattcccacttttatttcaccccgttgcttcgccgcatcgtcactgatagtgctgccatcttcttcaattcccgtcgaatggggatcgtgataataattcagatctaacgttggcgtgacaccaacagcagtacgccattcgctgtgtaaacccagccgcgtctgaatatcatcaccctgcgattgtgacacgcgcgcatggttagcggcggtaaaatcatcctgctgcacgccctgataaatcacctgcgtctgcggttcaatcaccacaccatgccccggtaaccactgataaccggcttccagcgaggcgataatccccgacgagtggtaatgatccacgccatcgtcttgttcggaaacatcattgttaaaccacacatattgcagccagctatccaaccaggccccctgcttctgattaccgtgctgataccagcttgaggtcagcccaacggcataaccgtggttctggttatcggcgcgagttccggtcatattcgagcggctgtcgccctggttatcgctgtagccaccaacaatcccaagcatccactcgccatcatcaccccagtgcccgctaaacaggttgccgctaagctgcaccgtagaagtgtcttcatgctgagccaactgccctaccgccgtgtaatgataacgcccgccgataacgcgtaaattcagcgtctgaccatcgccaccagcgtgatcgcgtcgctccatcacaaatgcctgatttgccgcacgtaggttattaaaatatccaccaactttggcattcaacaccggctggtaagcaggcgtaggtccagagtcgggggttgggtcgggatccggcgtgggatcaggatctggagtcgggtccggatcgggcggcggcgtcggattgacttcttgcgatcgcagataccagtcgttgttatcttccaccagcgtatagtcatacgctcccatattgacgtagccgcttcctgccagacggaactgtgcattgttttgaaactgcgtgggatcagctgcgaaatcaaccactttaatacctgtagatgtcggctcaccaataccagtaatggggttaattaccacggccgtgttgccagcagtattaccgttcaataccagttggtcacttgccgagtcatcgccgtttaattcgctgtcgagcagtagcgtaccgccgccggtataatcaccatttaccgtcagcgtgtcgccagcgacgccattttgcaggctaatcgcaccggacgtattggtcagattgccattaaccgtcacgtcggaaagataagtcaggctgtcagtttcaaggttggtattaagctcacctgccagcgtcacgccatcggtggcattcaccagcgtaccgtcgccgctaaacagcgaggcatccagcacctggttcgtatcctgctgcgtcaatcgcaacacagtaccatcggttatgtcgatatcgccgccagaggtggcatcgattgagcgaatatcctgattttgcccggtttcaaaaacaccgtcttcccccacccacagtgaagaaacataaggaataatattctccgcttcaccttttagcgttccgtcctccacacgtaccgcagacgtcgcagtgccgctggcggtcaactccagcgtaccgccgccacttttagtcaacgtgcttacgctatccagttgttgcccggtactatccgccatcaatccgccccattgcgtatctacgccatcctcaacgtgtatttcgccatcagcgcgcatttcaatattcctgccctgacctgttgtagccgagcgagtgtcaacatcagtcgtcacatccatttcactgtgttgttggggatctgtgaagatcactgaacggttgtaacttgtgtcccccaattgcgaattatcgctgacttcaagcgtaccggaggcgatttgcgtattaccgagataaccgttgttattcgccagcgttacgcgctgatcccccgcattaatgacgacataaacgccattctggctggcatcactgccgccaatatgtaaatcatcgccactgctgatatcaacgacatcattactgccaatcactgtccccccgctgccgctgatttgcagaccgtcattgtatgagctatcgccatcccaggtggtgaaatcagagagatccaatactccgccatttagcacgatcgattgcggatcgctctgcattgcccgtaaatcggcctgattccccgccagcgacaatacggcgttatcttccaccacaatatcgccggttaatgccatcgactgcgcccctgtcaggagatagctgccatcttgcgctaccgtcaactgtccttcaccctgaatcgagccggaaaaaccgccctggtttacggtaacattgccgcctgcgtcgatattcaaaatgccattagcaaaaccggttaatgagtgcacaaacgtttgttgtgtattgccaacattcagttctgcctgatactcagaatgaacagtgctgccgaccatcagaccaaagcaatcctgcggatcgctctgacagtgcgtgtcgccgacattcattaactcatcgctgcgccccaacgtcacctcgccattctggatacttatctcgccggtaaacgcattattgtcggcattgaggactaactctcccgctccctctttaacgatgactcccgttccggcaagagaatcaatcgcgccatcgttgctggtattgcctattaccagcgttttatcggcggcaatgttaaattcagccacactatgaccgatatacataaagccccccgccgctgccgtcgccgaatggtcatatcccgaggcgctgttattttcatcaatcatcacaccattgttttggtcataattatcatcaacagaaatatcaataagatacggggatgtggtgctgctggtataaattgctccgccataaccttctgcatagttattggtaaaggaggtattattaattatcgtttttcctgaaagatgtgtgttatccgtactattatccgtaacatcaatagcgccgccatccccatcactataacttgttgatgtatatgcctggttattattaaaagcatcatcacttaaatagacgtcattattgatggtataaattgcaccgcctttgccgtcattagcgatgttattgtgaaatacggcgttagtgacacgtaaatcggcggcaccggtatcattggtaccggcagaatagattgctccgccatagcctcctgcaacattactgtcgaaaataacattcgcaagatttatcgttgagttttctttagcaaagatagccccaccattattatattcgccactaaccgagttatcagcaaacagggtcatccctgtttcattttgtggtgatatcgtaaattcagcactgtgctgcaaaaatactgcgccaccgctggcattattgaccatacccgaaaaaatcaaccattgtccatccgcgatgctccagtcctgtatattacccgaaaggctttgcctgctggcctgacagctcgctttgatatcatatccctggcatgaatcaatgaccgctgcggcaccgttagcagagaaaagagatgcaatcattgacgggagtaaagataaatactccttgcgtagagagataatccgcatattcatctaaccatcattttctataagatggcgtatttaatcgcattatgcgatatagggtatttttcttttgtaagttctgcccctgatgtaataactattttgttattatctgataattaatttagatgcatcacaattcaaattaataactttaaggtaaatcggttatatttaaactgaattaaagcaataaataatattcttataataaatacaaaagtaacaaattggcttagtatttaacaataaccgaatataaaacaaccatttccgactcaacaatcgcttacactcgcttatatattgaccacaactgatacatcagattatgtgacgacttgtgcctagatcaattttggcaatcattagcaacaagattaataaaccatctatatcaatttacctatcctattttaccgttcaagaattcaccgaacggttatttttaacaaatttttctcttcccattgactttcccggacaccttgtctgacctaaggtgcgcggaagccactttttccttcctgagttatccacaaagttatgcacttgcaagagggccagtttcacactatcttgcagtgaatcccaaacataccccctatatatagtgttcttagcagcttccctcactacaggtagtctgcatgaagctattgaaaaacaggtacgacatacatgaatcagaatctgctggtgacaaagcgcgacggtagcacagagcgcatcaatctcgacaaaatccatcgcgttctggattgggcggcagaaggactgcataacgtttcgatttcccaggtcgagctgcgctcccacattcagttttatgacggtatcaagacctctgacatccacgaaactattatcaaggctgccgcagacctgatctcccgtgatgcgccggattatcagtatctcgccgcacgtctggcgatcttccacctgcgtaaaaaagcctacggtcagtttgagccgcctgcgctgtacgaccatgtggtgaaaatggtcgagatgggcaaatacgataatcatctgctggaagactacacggaagaagagttcaagcagatggacacgtttatcgatcacgaccgtgatatgaccttctcttatgctgccgttaagcagctggaaggcaaatatctggtacagaaccgcgtgaccggcgaaatctacgaaagcgctcagttcctttatattctggttgccgcgtgcctgttctcgaactacccgcgtgaaacgcgcctgcaatacgtgaagcgtttttacgacgcggtttccacatttaaaatttcgctgccgacgccaatcatgtccggcgtgcgtaccccgactcgtcagttcagctcctgcgtgctgattgagtgcggcgacagcctggattccatcaacgccacctccagcgcgattgttaaatacgtttcccagcgtgccgggatcggcattaacgccgggcgtattcgtgcgctgggtagcccgattcgcggtggcgaagcgttccataccggttgtattccgttctacaaacatttccagaccgcggtgaaatcctgctctcagggcggcgtgcgcggcggtgcggcaacgctgttctacccgatgtggcatctggaagtggaaagcctgctggtgttgaaaaacaaccgtggggttgaaggcaaccgcgtgcgtcatatggactacggggttcaaatcaacaaactgatgtatacccgcctgctgaaaggtgaagatatcactctgttcagcccgtccgacgtaccggggctgtacgacgcgttcttcgccgatcaggaagagtttgaacgcctgtataccaaatatgagaaagacgacagcatccgcaagcagcgtgtgaaagccgttgagctgttctcgctgatgatgcaggaacgtgcgtctaccggtcgtatctatattcagaacgttgaccactgcaatacccatagcccgtttgatccggccatcgcgccagtgcgccagtctaacctgtgcctggaaatcgccctgccgaccaaaccgctgaacgacgtcaacgacgagaacggtgaaatcgcgctgtgtacgctgtctgctttcaacctgggcgcaattaacagcctggatgaactggaagagctggcaattctggcagtacgcgcactcgacgcgctgctggattatcaggattacccgatcccggccgccaaacgtggagcgatgggtcgtcgtacgctgggtattggtgtgatcaacttcgcttactacctggcgaagcacggtaaacgctactccgacggcagcgccaacaacctgacgcataaaaccttcgaagccattcagtattacctgctgaaagcgtctaatgagctggcgaaagagcaaggcgcgtgcccgtggtttaacgaaaccacttacgcgaaagggatcctgccgatcgatacctataagaaagatctggatgccatcgctaatgagccgctgcattacgactgggaagcactgcgtgagtcaatcaaaacgcacggcctgcgtaactccacgctttctgccctgatgccgtccgagacttcttcgcagatctctaacgccactaacggtattgaaccgccgcgcggttacgtcagcatcaaagcgtcgaaagacggtattctgcgccaagtggtgccggactacgagcatctgcacgacgcctatgagctgctgtgggaaatgccgggtaacgatggctacctgcaactggtgggtatcatgcagaaatttatcgatcagtcgatctctgctaacaccaactacgatccgtcacgtttcccgtcaggaaaagtgccgatgcaacagttgctgaaagacctgctcaccgcctacaaattcggggtcaaaacgctgtattatcagaacacccgtgacggcgcagaagacgcgcaggacgatctggtgccgtcaatccaggacgatggctgcgaaagcggcgcatgtaagatctgatattgtgatgccggatgcggcgtgagcgccctacccggcctacggctccaatttgtaggccggataagcgaagcgcatccggcactggatgcccagatgcggcatgaacgccctacccagcctacgatgcggtttgtaggccggataagcgaagcgcatccggcataaaactcctaacaggacacattcatggcatataccaccttttcacagacgaaaaatgatcagctcaaagaaccgatgttctttggtcagccggtcaacgtggctcgctacgatcagcaaaaatatgacatcttcgaaaagctgatcgaaaagcagctctctttcttctggcgtccggaagaagttgacgtctcccgcgaccgtatcgattaccaggcactgcctgaacacgaaaaacacatctttatcagtaacctgaaatatcagacgctgctggattccattcagggtcgcagtccgaacgtggcactgctgccgctgatctcgatcccggaactggaaacctgggtagaaacctgggcgttctcagaaacgattcattcccgctcctatacccatatcatccgtaatatcgttaacgatccgtcagttgtctttgacgatatcgtcaccaacgagcagatccagaaacgtgcggaagggatctccagctattacgatgaactgatcgaaatgaccagctactggcatctgctgggcgaaggcacccacaccgttaacggtaaagccgtaaccgttagcctgcgcgagctgaagaaaaaactgtatctctgcctgatgagcgttaacgcgctggaagcgatccgtttctacgtcagctttgcctgctctttcgcattcgctgaacgtgagctgatggaaggtaacgccaaaattattcgcctgattgcccgcgacgaagccctgcacctgaccggcacccagcatatgctgaatctgctgcgcagcggcgcggatgatccggagatggcggaaattgccgaagaatgtaagcaggagtgctatgacctgtttgtccaggcggcacagcaagagaaagactgggcggattatctgttccgtgatggttcgatgattggtctgaataaagacattctctgccagtacgttgaatacatcaccaatatccgtatgcaggcagtcggtttggatctgccgttccagacgcgctccaacccgatcccgtggatcaacacctggctggtgtctgataacgtgcaggttgctccgcaggaagtggaagtcagttcttatctggtcgggcagattgacgcggaagtggacaccgacgatttgagtaacttccagctctgatggcccgcgttaccctgcgcattactggcacacaactgctgtgccaggatgaacacccttcccttctggcggcgctggaatcccacaatgtggcggttgagtaccagtgccgcgaaggttactgcggctcctgtcgcacccgactggtcgcaggccaggtggactggattgccgaaccgttagcttttattcagccgggggaaattttgccctgttgttgccgggcaaaaggcgatattgaaatcgagatgtgaattggttttaacgccagatacgacgcttatacgtcttatctggcctacaacgattacatagcgtagtaatatgctttcacctgctcccagtccgctttggggatcggctccagatatttttccagctggcggaagtcatgattaatcgctttatcacgacgcaagcggcgacgacttttctccaggtcaagaaatccagcttctgccttaccttctgttttcacatagatatggcgaacataacaacagccatgctgacgattaacgctatgcattttcttaaacgccagcgccactgctttcaacatggcttgccgtacttcgtcagaataaggcgatactgcatgccgggcataccagtcagcaatgctgatgaaccccgccatatcttcagtcaccagcaacgcgcgccattcaccctcaattttcaccgcttcaccaaaaacgatcttcggcacgatgacaccggcccgttccagttctttaattaccgcaacctcacggacaatcgttggtcggccgaacggataacgtacggaatgaaacagatgatgcgtcatgcgctttacatacagctttttgccgttgcgctcgacgcattgcaccccgctcataccattacggcgatagttaggctcttcaacccagtcgccctctgttgcccaccagtgattaaattcgtcgtgctttgctgaaactgccataccctatcgcctgtcgttttttattaacggcaatgactatagatgtttagctgaggaaaatcttaataatacgtgttgtattgacgagtatcttatgccgggaacaagtcatctcgctctaaataattgcaattaaggataacccacagactttaatgaagagtggtatcggatagcacataagtgccatccggtagttaatttactctttattaaggaattttactgccttatcagggaaatcagtaaatagcccatttacacccgctttgttatacagagcatcatataactgattcacatcagtagtgtattcaggcagtttatctgaccgcacggtataaggatgcactaccagtttattctgctgagcatcttgcaccatgccagtgagtttgatattacccggctgcgatgtctcctcaatcaacatatggtaatccggaccaataccatcagcatattccgccacctgtttcatggcacccggcttaaacatccagtcgtaattgtaattaacccagcttccgtccggctgtttctgctgcgtttcattccagtcggtataggcaatcaactgtaccagattgagatccatacccattttgggttccagcacattcttaatacgcttcagctcatcagcatcaaaacattgcaaataaactttgtcgtccttaccggtgtaaccatatttcttcagcacttccagcgtttttgccgcaatatccttcccttcctgatgatggaaccacggcgctttaatttctggatagataccgatatttttcccggtagagtggtttaacccctgaacaaattcaatctcttcttcaaaggtgtgcacccggaagtcagatttacccattgggaaacgccccggataagtctgcacttttttaccgttttcaatatcgaaaccttcggtaaatttcagcgacttaatttcatccagcgtgaaatctatcgcgtagtaacgaccgtctttgcgcgcccgatccgggaaacgatcggcaacatcagtaacacgatcgagataatggtcatgcagaacaaccagatggtcgtctttggtcatcaccaaatcctgttccagataatccgctccctgcgcatacgccatcgcttttgctggcagcgtatgctccggcaaatatccactggcaccgcgatgggcgatgactattttttcgttgctgtccgccgccattgcactgcttcccatgactatagtgctcatcatgatcgccatgctaaggtttttcagcgtcaatttcatgccattagcctccgttgcgtttttgcagtaattgttcatggcgacgtttttcgccaatcatcacaacaatcaacaagataaccgccagaatgctgccgccaatcattaccataaagccgccatcccagccgaagaagtccacggtgtagccaacaatcgcgctcgccgccaccgaaccgccgaggtaaccaaacagcccggtaaaacccgctgccgtacctgccgcttttttcggtgccagttccagcgcatgtagaccgatcagcatcacagggccatagatcaggaagccgataacaatcatacaaatcatatcgacggttggattacctgccgggttcatccagtaaacgatagtcgcgatggtcaccagtgtcataaagaagacgccggttgccccacggttaccacgaaagactttatccgacatccagccgcacagcagggtgcccggaatacctgcatattcataaagaaagtaggcccaagaggatttatccagcgcgaaatgcttaacctctttcagataagtcggtgaccagtcgaggatgccgtaacgcagcagataaacgaacacgttggcgatggcgatataccacagcagtttgttcggcagcacgtactgcatgaagatctgcttcgcggtcagctcctgttccgctttttcgttatagtcgtccggataatcatttttgtactcttcgatcggcggcaggccacaggattgcggggtatcgcgcatcatcgcaaaggcgaacagtgccaccagaatggcacagaaagcgggcatatagagcgccgcgtgccagtcattgaaccaggccatccccagcaggaacagcagcggcggaataccaccaccgacgttgtgcgcacagttccacactgacacaataccgccacgttctttctgcgaccaccagtgcaccatagtacgaccacacggcggccaccccatcccctggaaccaaccgcagaggaacaacagtacaaacatcaccgcaatgctcgacgtcgcccatggcacaaagcccataaacaacatcactgccgccgccagaatcaaacctgcgggcaggaaaacgcgcggattcgagcgatccgataccgaacccatgatgaatttcgaaaatccataagcaatcgagatccccgaaagggcaaaacctaaatcaccgcgtgagaatccctgctcaaccagataaggcatagcgagcgcaaagttcttacgaaccaaatagtaagcagcatagccaaagaatatccccaggaaaatttgccagcgcaatcgacgataagtcggatcgatctccgcggcaggtaagcgcgctttgtgtggcgctggtttaaaaatactcaacattgatagcctccgtggcccgtggtcttatttatgattaacagcctgattcagtgggagaacctgccgtttcttgagttgccgcgatgttaagaaaacattcataaattaaatgtgaattaccgcacacattattaaatacgatggttgaaatgttcagaatgacgcatgaaatcacgtttcactttcgaattatgagcgaatatgcgcgaaatcaaacaattcatgtttttactatggctaaatggtaaaaaacgaacttcagagggataacaatgaaaactcgcgactcgcaatcaagtgacgtgattatcattggcggtggcgcaacgggagccgggattgcccgcgactgtgccctgcgcgggctgcgcgtgattttggttgagcgccacgacatcgcaaccggtgccaccgggcgtaaccacggcctgctgcacagcggtgcgcgctatgcggtaaccgatgcggaatcggcccgcgaatgtattagtgaaaaccagatcctgaaacgcattgcacgtcactgcgtagaaccaaccaacggcctgtttatcaccctgccggaagatgacctctccttccaggccacttttatccgcgcctgcgaagaagcagggatcagcgcagaagccattgatccgcagcaagcgcgcattatcgaacctgccgttaacccggcactgattggcgcggtgaaagttccggatggcaccgttgatccatttcgtctgactacagcaaatatgctggatgccaaagaacacggtgcggttatccttactgctcatgaagtcacgggactcattcgtgaaggcgcgacggtgtgcggtgttcgtgtacgtaaccatctcaccggcgaaattcagacacttcatgcgcctgtcgtagttaatgccgccgggatctgggggcaacacattgccgaatatgccgatctgcgcattcgcatgttcccggcgaaaggatcgctgctgatcatggatcaccgcattaatcagcatgtgatcaaccgctgccgcaaaccttccgacgccgatattctggtgcctggcgataccatttcgctgattggcaccacctctttacgtattgattacaacgagattgacgataatcgagtgacggcagaagaagttgatattctgctgcgcgaaggggaaaaactggcccccgtgatggcgaaaacgcgcattttgcgggcctactctggcgtacgcccgctggttgccagcgatgacgatccgagcggacgtaacgtcagccgtggcatcgtgctgctcgaccatgctgaacgcgatggtctggacgggtttatcaccatcaccggtggcaaactgatgacctatcggctgatggcggaatgggctaccgacgccgtatgccgcaaactgggaaacacgcgcccctgtacgaccgccgatctggcacttcctggttcacaggaacccgctgaagttaccttgcgtaaagtcatctccctgcctgccccgctgcgcggttctgcggtttatcgtcatggcgatcgcacgcctgcctggctgagcgaaggccgtctgcaccgtagcctggtatgtgagtgcgaagcggtaactgcgggtgaagtgcagtacgcggtagaaaatttaaacgttaatagcctgctggatttacgccgtcgtacccgtgtggggatgggcacctgccagggcgagctctgcgcctgccgcgctgccggactgctgcaacgttttaacgtcacgacgtccgcgcaatctatcgagcaactttccaccttcctaaacgaacgctggaaaggcgtgcaacccatcgcctggggagatgcactgcgcgaaagcgaatttacccgctgggtttatcagggattgtgtggtctggagaaggagcagaaagatgcgctttgatactgtcattatgggcggcggcctcgccggattactctgtggcctgcaactgcaaaaacacggcctgcgctgtgccattgtcactcgtggtcaaagcgcgctgcatttctcatctggatcgctggatttgctgagccatctgccggatggtcaaccggtgacagacattcacagtggactggaatctttgcgtcagcaggcacctgcccatccttacactcttctcgggccacaacgcgtgctcgatctcgcttgccaggcgcaggcattaatcgctgaaagcggtgcgcaattgcagggcagcgtagagctggctcaccagcggattacaccgctaggcactctgcgctcaacctggctaagttcgccagaagtccctgtctggccgctgcccgcgaagaaaatatgtgtagtgggaattagcggcctgatggattttcaggcgcatcttgcggcggcttcattgcgcgaattggaccttaaagttgaaaccgctgaaattgaactgccggaactggatgtgctgcgcaataacgccaccgagttccgggcggtgaatattgcccgcttccttgataatgaagaaaactggccgttgttacttgatgcgcttattccggtcgccaatacctgcgaaatgatcctgatgcccgcctgcttcggcctggccgatgacaaactgtggcattggttgaatgaaaaactaccttgttcattgatgcttttgccaacgctgccgccttccgtgctgggcattcgtctgcaaaaccagttacagcgccagtttgtgcgccagggcggcgtgtggatgccgggcgatgaagtgaaaaaagtgacctgtaaaaatggcgtagtgaatgaaatctggacgcgcaatcacgccgatatcccgctgcgcccacgatttgcggtgcttgcgagcggcagtttctttagcggcggactggtggcagaacgtgacggcattcgcgagccgattctcggccttgatgtgctacaaaccgctacgcggggtgaatggtataagggcgatttttttgcgccgcagccgtggcagcagttcggtgtaaccactgatgaggcgctacgcccgtcgcaggcggggcaaaccattgagaacctgtttgccatcggttcggtgctgggtggatttgatcccatcgcccagggatgcggcggcggtgtttgtgccgtcagtgctttacatgccgctcaacagattgcccaacgcgcaggaggccaacaatgaatgacaccagcttcgaaaactgcattaagtgcaccgtatgcaccaccgcctgcccggtgagccgggtgaatccgggttatccggggccaaaacaagccgggccggatggcgagcgtctgcgtttaaaagatggcgcactgtatgacgaagcgctgaaatattgcatcaactgcaaacgttgtgaagtcgcctgcccgtccgatgtgaagattggcgatattatccagcgcgcgcgggcgaaatatgacaccacacgcccgtcgctgcgtaattttgtgttgagtcataccgacctgatgggtagcgtttccacgccgttcgcacccatcgtcaacaccgctacctcgctgaaaccggtgcggcagttgcttgatgcggcgttaaaaatagaccaccgtcgcacgctaccgaaatactccttcggtacgttccgtcgctggtatcgcagcgtggcggctcagcaagcgcagtataaagaccaggtcgctttctttcacggctgcttcgttaactacaaccatccgcagctaggcaaagatttaattaaagtgctcaacgcgatgggtaccggcgtacaactgctcagcaaagaaaaatgctgcggcgtaccgctgatcgccaacggttttaccgataaagcacgcaaacaggcaattacgaatgtagagtcgatccgcgaagctgtgggagtaaaaggcattccggtgattgccacctcctcaacttgtacatttgccctgcgcgacgaatacccggaagtgctgaatgtcgacaacaaaggcttgcgcgatcatatcgaactggcgacccgctggctgtggcgcaagctggacgaaggcaaaacgttaccgctgaaaccgctgccgctgaaagtggtttatcacactccgtgccatatggaaaaaatgggctggacgctctacaccctggagctgttgcgtaaaatcccggggcttgagttaacggtgctggattcccagtgctgcggtattgcgggaacttacggtttcaaaaaagagaactaccccacttcacaagccatcggcgcaccactgttccgccagatagaagagagcggcgcagatctggtggtcaccgactgcgaaacctgtaaatggcagattgagatgtccacaagtcttcgctgcgaacatccgattacgctgctggcacaggcgctggcttaaactcctttctgatgcccggtaagcatgttgttaccgggcatttttgcgtacacgattccgtgcccaatgtatgcgttgcaacgcagtgaaaattcctctgaaaacgtctcgcaaaggctgaaactggcagatgtcaaaggcctgggataaccgtaatgtcgcgtcatcataaatatcaggtgacggacaaccatgaccgaatcaacaacctcctccccgcatgatgcggtgtttaaaacctttatgttcacacccgaaaccgcacgggattttctggaaatacatctaccagagccgctgcgcaagctttgcaacctgcaaaccttacgcctggaacccaccagttttattgaaaaaagtttacgcgcttactactcggatgttttgtggtccgtggaaaccagcgagggtgacggctatatctactgcgtgattgaacatcaaagctctgcagaaaagaatatggcttttcggctaatgcgctatgccactgccgccatgcagcgtcacctggataaaggctatgacagagttccgctggtggtgccattgctgttttatcatggcgaagcctcgccctacccgtactcactcaactggctggatgagtttgacgatccgcaacttgcccggcagttgtacaccgaagcttttccgttggtggatatcaccatcgtacctgacgatgagatcatgcaacatcggcgtatagctctgctggaactgattcaaaagcatattcgcgaccgcgatttaatcggtatggtcgacaggatcaccacgcttttggttagaggcttcactaatgacagtcagctacaaacactgtttaattatctgctgcaatgcggcgatacctcccgtttcacccgctttattcaggagattgccgaacgttcaccactacaaaaggagagattaatgactattgctgaacggctacggcaggaaggacatcaaattggctggcaagaaggtaaaattgaaggtttgcatgagcaagccattaaaattgccttgcgcatgctggagcagggctttgaacgtgagattgtgctggcggcaacccaactcactgatgctgatattccgaactgtcattaaaaggagagattgatgactattgctgaacggctacggcaggaaggacatcaaattggctggcaggaaggtaagattgaaggctggcaagaaggtaaattagaaggtttgcaggaaggcatgcatgaacaagccattaaaattgctttgcgcatgctggagcagggcattgatcgtgaccaggtgctcgcggccactcagctaagcgaagccgatctggcagcgaataaccactaattaacacaggcccacagccgatccccatgggcctttgatatcaataactaccttttacgcgtggcccatttttgcctgatttaaacatcgccagtcgttgatccagggcatcgctgtagagcatcgtgtcaacgccaacagcgacaaagttcgctccccacgccaggcattgctgcgccatatcaggagccacagccagaaaaccagccgctttacccgcagcacggatccgccgaatgctggtttcaataattcgctgcacttccgggtgcccggcgttatccgggtagcccaacgacgcagaaagatccgcaggtccaataaacacgccatcaatcccttcgacatcgaggatttcgtccaggttatccagtgccgttttactttccacctgcaccaacagacaaagcgaatcgttgacttgcgccatgtaattctcaatgcgtccccagcgtgcagcccgtgccacactggccccaacaccacgctcaccgtagggaggatagcgcgtggcagacaccacctgacgtgcctgatcggcagtatcgaccatcgggatcagtagagtttgcgcgccaatatccaggacttgtttaatcagcggcttactgccttccaccggacggatcacggggtggctggcatagggcgctaccgcctgtagctggtgataaagatcctgaattgtgtttggcgcatgctccccgtcaatcagcaaccagtcataaccggaagtggcggcaatttctgccatataggcagtcgttgagcttaaccacagaccaatttgcacttcgcccttgcgtaaacgttctttaaagggattggttaataatgcgttcatcgtgttccttaaactatttaatgatgtgccacgtcggtctgcgcaacagtgcgatttacacgcagagtgaaaataatcagcgaaccgatgaccgccaccgctgccagcgtcagtaatcccgccgcatcgctggaaaataacgtttctgctttcacgcgcaggatcgggtcaataaacccgcccactgcaccaaacaggtttataaaaccaatccccgcagccagcgccgtaccggaaagaagctgtgtcggcatcgtccagaacaccggttgcacggcaataaacccgatggctgcaacacacagtgctacgatcgccagtactggagaaagcagcccggacagaccaataccaatgcccgccgccagtaatgtcagcgctgcgacattacgccgttcgccggttttatcggagtagcacggaataagccaggtcccaaacaaggccgcaacccacggaatggcggtgaccaccgacgccgtaaagcccacttttgtccccagcaatgcagcaacctgggtcggcaggaagaaaattaatccgtaaaccgccacctgaatggtcaggtagataatcgccagttgccagactcgcccattacgcaacgcatcgctcagtcgcgaagtcactttctgttgttcttcacttgccagttgattgataagtaacgttttttcttgtttactcagaaaacgtgcctgctccggtgtgtcatcaagccaaaagaatgtgaataccccagcgccgactgccaacaatccttcaatcacaaacatccagaaccagccgggatgccccataaatccatgcatctccagcagcgcgccagaaagcggtgatcccagtgttaacgccagcggtgcgcccatatagaacagccccataatgctggcgcgattacgctgcggaaaccattgcgaggtgagataaatcataccagggaaaaacccagcctccgcagcaccaagcagagtgcgaacaatcagaaatttcgcttcagtatcggcccatgccatggcagccgaaagaaatccccacagcagtgttgtcgtaccaatccaggttcttgcccccagtttgcgcatcaaaagattcgccggaacccccagaaacgcgtataccacaaagaaaatgcctgctcccagcgcataagcttcattactcagcccggtatcaatctggtaggtctgtttggcaaaaccaatattcgaacggtcgagaaacgccagcacatacagcgccaacataaacggaattaaacgcgcgcggtttttcttcaccacggcgtcaagcaaagcggtgctcataaaaagctccttagaatatgtgggcgttaccgttgtcacagcaacgcccggagtgattagtggctgtagggggggttcaaattgcagtcacgattgagttcgacgccgaaaccgggtttatcaagcactgatttatgaatacgaccattcaccggaaccggctcattaagcagaatcggatcaaattgcggacgcatcgttgaacaatccgggctggtcatcaggaattcactgaatggcgtattggtgaaggtgatcaccgcatggtgggagtaaacagacgaaccgtgcggcaccaccagttgccccctggatttggcgattgcggcaatttccaccagcgtggttaagccaccgcaccagccaacatccggctgcataatgtcgataccggtttctgaaagcgtacggaaagattgcagtgtgccgtggtgctcaccgctggtgaccatcatccccgctggtgcgttgtgtttcagttcgcgataaccttcatactgctgtggcggcaggcactcttcgatccatttcaggttatagggcgcgcaagcgtgggccagtttgatggcatagttcacgtcctgactcatccagcagtcgagcattaaccagaaatcctcaccgcatttttcacgcatatccgcgaccatagcggcatctttgcggatccccgcatcaccatcatgtggcccccagtgcgtcggcattttgccaccgataaagcccatctcttttgccagatccggacgcgcacctgtggcgtagaactgaatctcatcacgaactgcgccgcctaaaagtttataaaccggaagcccgaccactttgccgaacagatcccacagagccagatcgacacaggaaatcgtattcatcaccaggccaccagagccggagtaatacagggtggcattgagcatttgatcgtggatcagtttgatatcactgacgcatttaccctcaatgaaacggttaagatgtttttcgacaataaaacaacccatttcaccggctgtcgaaacggcgaatccggtctggccgttttctgcttcaacttcaacaatcaacgtgccaagaacgttaatgccaaatgactggcgggactgctcgtattcgcggtatttactcatcggggtggcaatatgatcatcaatccagtgattcgccccctggtcgtgataatcaccgccgccagcgcctttttctgctgtcgcaccgccagtaaaccaggcgcgaacctgtttgatttttggtagggtcatgatgttctccattgttatgaggcctgtaagtcaaagggacttttccatcccaacaaacgtgaaatatccctggcgcaggcaatggccttgcccgccagataatcacggtattcttcattgatttgtaagcgggtaccgaccaccgaaatcgcagcagtaagctcgttattggcgttaaacaccggcgcagcgacacaacggacatcggcgtaatcttcgccgttgtcatagctccagccctggcggcgaatacgcgccagttcttcgtgaagttgctgtggatgagtaatcgttgtgggtgtcgcccgttcccagaccagcccttcgataatgctttgctgtacagctgcaggttgccaggcaagcaggcatttacctattccggagcgataaagcgaaaggctttttccttcatgggaacgcacgctgatagtggctgatgactccactttcaaaatgtaataagcgctgccgttatcaataatccccaggtgacataacagcccggtggtatccatcagttgcgtcaaacgcggtcgagccagttcccggagatccatcttgcttaacgcatgaccggaaagctccaccagcctggtccacaaacaaaaattttcctgatgatcaaggctaagaaaacgctgacgcctgagttcattaagcagcaaataggctgtgcttttagggatccccaatgtgtcaatgatcgtcgcagcactacaggggccaatccgggcaatcaaattgagaatatcaatagcccgtgtcagggcgggaactttgcttgattccaacatactggactccagtcttagatactggaatcagtctcgttgctcagggggagtaaaattgtgaagcgcatcaaatcccgtttctcgtccagcggactggagaaattacgcacaaatttgtgaatcagcgcacggattttttcttattgagtacaacaggttggacaaattttgccggagggggaatgtgccggtgcagtaaaccggcacagagtggcggaatcagacagataaggtcatggactcaacaacctcaatccagccatgctcgctggcgatgtcctggccgtttaaccaacggcgtagcatattaagcgccatcattgcgcagacttcctggcgaatagccagactgtagcgtgtggcactgaaatgtacacgcaaagcgaaagtgccgtctggcgtggctagtgcaaagttgagatgctcatcttccagaccagaaacagccagtgccaacccagcaaaatggttcgcccgccgttctgtaatccagtgcgcagtttgcgccagggtttcctcctgtgaaggaaccacttcacacgccagcaatggagcatctgcgcgagaaagttgcaaagccaataaaccaccggtgaattgctcgctcagcgtcaggctgaactggcggctctgcaattcgcgactgatctgcgcgggcagtccttcggtgccttcgaaaatcacgctctgtccagcaacacgtttaacgtccagccacagtttttccatcgcctgttcctcgcttgccggtccggtgagtttcagttcgataatcggcattgaggagcgatagcccattgttacgcccggcggcagttgtagagtgtccaggctttgtgccagatcgctttccgaacgaccaaaggtagtcaaacgcaggcaaaccggcggctgtggtaaagaaaaacgctcgcgcaggcgcggcaggatttcgtgttcgaccatcaccttaaattctgacggtacgccgggggtaaagaacatcaggcaacgattaagctgtatggcaaaaccacaggcagtgcctaccgggttattgataaattcagcactggcaggcagctccgcttgtttacggttgctcggtgccattactcgtccccgttcgtggaaatagcgttccatctctttgagccaggcttcatgcagcaccaggccttcaccttttgctgtcgcagcggcgagtgcgcttaaatcatcactggtcggtcccagcccgccgttaacgatcagcacatcggcgtgctgactacgttcgcgaagaatggtgactaagtcatcaaggttatcccccaccgtattgcggcgagataatggcagcccctgatgaaagaaaaaatcggccagccaggcagcgttagtgtcaacgatttgcccgtgtaacacttcatccccggtggataacatttccacttttaacatggttatctcctgcttttgttatcgaatcactataacgcaaagggagacagggcgtagtaagaaactgaatggcgcgacagaacgccgcgccggaaggcgtcagaagctggcatttaccccaacatacgggccatcagcaatggcgttatcacgattgccatttttacctgccaggttcaggtaacggtagccagcctcaatgctgactggacgcataatggtgtaacgcgcgccagcattcgcttcttcataacttttaattccgctggagagcgaatccggagagtagtaatactcaccaaacaaacggaagctgtcaccaatttgccactgcaaaccaccgccaactgccgctgcataaccttcatcaccatcgttcgggttggtgtaaacgccttttccgccaacggtcgccattaatggcccgagaggcagattcaaccccagccccacgcccgcggcatcaccgtcgtcgtcgttatgtgtccagttaccgcttaacgccaggcccgtcgattcagtcccaaaaccgacaccaatattggtgtattctttacccgcctggccgctgatgctcattgcattgaccgatgcagaaaccaacagcattccggccagacctgctagcgcaatttttttcattatcccctttcccacaagcaattaattaaaattcccaaagctgcgggattgtactgcctggcgcagaggattcaatgagcgaaaaaagggatctagtcacttattgtaactaaatacttcttaaataattaaacgccgaaaaaataaacacactttatcgatacatacaaaaataataataaatgtagttatcatcgcaaaagagattactgtcactttcacatatttctgagttaccgtattctcatggtttctttttatttataaggaatacccctgtgcgacaacggaccattgtatgccctttgattcaaaatgatggtgcttatttgctgtgtaaaatggccgacgatcgcggcgttttccccggtcaatgggcgctttcgggtggcggcgtggagcctggcgaacgaattgaagaggcactacgccgcgaaattcgcgaagaactgggagaacagctgcttttgacagaaatcacgccgtggaccttcagcgatgatattcgcaccaagacgtatgcagatggtcgcaaggaagagatttatatgatttacctgatttttgactgcgtttctgccaaccgagatgtgaaaataaacgaagagtttcaggactacgcgtgggtaaaacctgaagatctggtgcattatgatttgaatgttgccacccgaaaaacgttacgtttgaaaggtcttctttaacaatgatgacagccatcactggctgtcagattgaaaatttagtggttaacgaattccccatccagataaactttgcctttttccacatgcatgactaaaccatccagataatcaggtttaaatgtcgcatcacgcttatctttagcaatatatgtcaggcaatgattatgggtaaaaataacgatatttttatcaggtgctttgcgttgtaagtctttaattgcactataaatctcattaccgcattgaagaaatcgtttatctaccgtcagctttttacccgccgaaaaccaggtcgccgactgaatagtccggacggtattactggaatagagatcaaaatcagggatatcagcactaaaagcgttgcccagttcacgggcatcctgggtacctttgaccgtaatacctgttttatctgacaagcattgattggttgaacgatcgcaacgttcagcatggcgaaacaaaacgacaaccgggtgctgctgtgccagtctggccagtgttttattgtcgatgcgtggcaaaccattgctactccaggcggcatgagtacccagtccggcaatcgcagcgagcgccagtaaaatgatgaaatatttttttgacttcaacgaagatcggcaaaaagctaacacgtaaactccacctgtagacaagcgcaaccagacaattaccgtgaaattgagcgacttttctggcgataattagcagttggtgtaatattaaaaatcctatgatgccggcaaaatgcctcaaaattttgccaaatgcaaagtctaaataagaaaaaatataaaaatttcaatatttacgtctaatattagtttcttaaggttaagttaatattctatccttaaatttttgctccaaatggcaaaatatacacaacactctttatagcaaatataagtggacaggtattcaatgacggatggaaaaaaaatgtcaggatttttgcctttttcgcgaccagcaatgggcgtagaggaactcgctgcagttaaagaggttctcgaatccggttggatcacaaccggtccgaagaatcaggcgcttgaacaagctttttgccagttgacgggaaatcagcatgccatcgcggtcagttcagccaccgccggaatgcatatcacgctaatggcgttggaaattggcaagggcgatgaagtgattacgccttccctgacctgggtttcaaccctcaatatgatttccttgctgggtgcaacgccggtaatggtggatgtcgaccgcgatacgctgatggtcacgcctgaagcgatcgaagcagccattacgccacgcactaaagccatcattccggtgcattatgccggtgcgccagcagatattgacgccattcgcgccattggcgaacgttacggcatcgcagttatcgaagatgctgcccatgccgtcggtatgtattacaaagggcgacatattggcgcaaaaggtactgctattttttcgtttcacgccatcaaaaatattacctgtgcggaaggtggcctgattgttactgataatgaaaatcttgcccgccagctgcggatgctgaaatttcacggtctgggtgtcgatgcctatgacagacatacctggggccgtgcaccgcaggctgaagtcttaacgccgggctataagtacaatctgaccgatattaacgccgcgattgccctgacacagttagtcaaattagagcacctcaacacccgtcggcgcgaaattgcccagcaatatcagcaagcactggcagctctcccctttcagccattaagccttcccgcctggccgcacgttcacgcctggcatctgtttattattcgtgtcgatgaacaacgttgtggtatcagtcgcgatgcgttgatggaagcgttaaaagaaagaggcattggtgccgggttacatttccgcgccgctcacacacaaaaatattatcgcgagcgttttcccacgctgtcgttaccgaataccgaatggaatagtgaacgcatctgttcgttgccgctgttcccggatatgaccaccgccgatgccgaccgcgtcatcacagcccttaagcaactcgcaggacaataagccatgtttgaaatccaccctgttaagaaagtctcggtggttattcccgtttataacgagcaggaaagcttaccggaattaatcaggcgcaccaccgcagcctgtgaatcactggggaaagagtatgaaatcctgctgattgatgacggcagtagcgataattccgcgcatatgctggtcgaagcctcacaagcggagggcagccatattgtgtctatcttgcttaaccgcaattacgggcaacattcagcgattatggcgggattcagtcacgtcaccggcgacttaattattaccctcgatgccgatctccagaatccgccagaggaaatcccccgtctggtggcaaaagccgatgaaggttacgacgtggtagggactgtacgccagaaccgccaggacagctggtttcgtaaaaccgcttcaaagatgattaaccggcttattcagcgcaccacaggcaaagcgatgggtgactatggttgtatgctgcgcgcctatcgccgtcatattgtcgatgcgatgttgcactgccatgaacgcagcacctttatcccgattctggcgaatatcttcgcccgccgtgccattgaaattccagtgcaccatgccgagcgtgagtttggtgaatccaaatacagctttatgcgcctgattaatttgatgtacgacctggtgacctgtcttaccacaacgccgctacgtatgctgagtctgctcggcagcattattgcgattggcggttttagcattgcggtgctgctggtgattttacgcctgaccttcggaccccaatgggcggcagaaggcgtctttatgctatttgccgtgctgtttacttttattggcgctcagtttatcggcatgggattgctcggtgaatatatcggcaggatctacaccgatgtccgcgcccgcccccgctattttgttcagcaagttatccgtccatccagcaaggaaaatgaataatgaaaaccgtcgtttttgcctaccacgatatgggatgcctcggtattgaagccctgctgtctgccggttacgaaattagcgccatttttacccatactgataaccccggtgaaaaagccttttatggttcggttgcccgactggcagcggaaagaggcattccagtttatgcgccggataacgttaatcatccgctgtggatggaacgcattgcccaactatcaccagaggtgattttctctttttattatcgccatcttatttgcgatgagattttgcagctcgctccgagaggtgcatttaatctgcatggttcgctgttaccaaaatatcgtggtcgcgcgccgctgaactgggtgctggtgaacggtgaaacggaaactggcgttacattgcaccgaatggtgaaacgtgccgatgccggggccattgtggcacaactgcgcgttgccattgcgccagacgatatcgccattacgctgcatcataaattgtgccatgccgcgcgccagctactggaacagacattacccgccattaaacacggtaatattctggaaatcgcccagcgcgaaaacgaagccacctgttttggtcgcagaacgccggatgacagtttcctcgaatggcataagccggcatccgtactgcacaacatggtgcgtgccgttgccgatccgtggccgggtgccttcagctatgttggcaatcagaaattcaccgtctggtcgtcgcgtgttcatcctcatgccagcaaagcacagccggggagcgtgatttctgttgcaccactgctgattgcctgtggcgatggcgcgctggaaatcgtcactggacaggcgggcgacggcattactatgcagggctcgcaattagcgcagacgctgggcctggtgcaaggttcacgcttgaatagccagcctgcctgtgccgcccgacgccgtacccgggtactcatcctcggggtgaatggctttattggcaaccatctgacagaacgcctgctgcgcgaagatcattatgaagtttacggtctggatattggcagcgatgcgataagccgttttatgaatcatccgcattttcactttgtcgaaggcgatatcagtattcattccgaatggattgagtatcacgtcaaaaaatgtgatgtcgtcttgcctttggtggcgatagccacgccgattgaatatacccgcaacccgctgcgcgtatttgaactcgatttcgaagagaatctgcgcattatccgctactgcgtgaagtaccgtaagcgaatcatcttcccgtcgacttcagaagtttatgggatgtgtagcgataaatacttcgatgaggaccattctaatttaatcgtcggcccggtgaataaaccacgctggatttattcggtgtctaaacaattacttgatcgagtgatctgggcctatggcgaaaaagaaggtttacagttcaccctcttccgcccgtttaactggatggggccacgactggataaccttaatgcagcgcgaattggcagctcccgcgctattacgcaactcattctcaatctggtagaaggttcaccgattaagctgattgatggcggaaaacaaaaacgctgctttactgatattcgggatggtatcgaggcgttataccgcattatcgaaaatgcgggaaatcgctgcgatggcgaaattatcaacattggcaatcctgagaacgaagcgagcattgaagaactgggggagatgctgctggcgagcttcgaaaaacatccgctgcgccattacttcccaccgtttgcgggctttcgtgttgtcgaaagtagcagctactatggcaaaggatatcaggacgtagagcatcgtaaaccgagcatccgcaatgcccgccgctgcctgaactgggaaccgaaaattgatatgcaggaaaccatcgacgaaacgctggatttcttcctgcgcaccgttgatcttacggataaaccatcatgaccaaagtcggcttacgcattgatgtcgatacctttcgtggcacccgtgaaggcgtgccgcgtctgctggaaatcttgagtaagcataatattcaggccagcatttttttcagcgtcggcccggacaatatgggccgccatctctggcgactggtgaagccacagtttttgtggaagatgctgcgctcaaacgcggcatcgctttatggctgggatattttactggcaggtacggcctggccaggtaaagagattggtcatgccaatgctgatatcattcgtgaagcggctaaacatcacgaagtcggcctgcacgcctgggatcaccatgcctggcaagcccatagcggtaattgggatcggcaaacaatgatcgacgatattgcacgcggccttcgcaccctggaagagattatcggtcaaccggtaacctgttctgccgctgctggctggcgtgctgaccaacaggtgatcgaagcaaaagaagcgttccatttgcgctacaacagcgattgtcgtggggcgatgccgtttcgtccattgctcgaatcaggaacccccggcactgcgcaaattccggtgaccttacccacctgggatgaagtgattggtcgggatgtgaaagcagaagattttaacggttggttactcaaccgcatccagcgagataaaggcacgccggtttataccattcatgccgaagttgaaggctgcgcttatcagcataattttgtggatctcctgaaacgcgcagctcaggaaggcgtgacattttgccctttaagcgaactattatcagggacgttgccgctcggacaagttgttcgcggaaatattgccggacgtgaaggctggctgggttgccaacaaatggcgggtagtcactgatgaaatcggtacgttaccttatcggcctcttcgcatttattgcctgctattacctgttaccgatcagcacgcgtctgctctggcaaccagatgaaacgcgttatgcggaaatcagtcgggaaatgctggcatccggcgactggattgttccccatctgttagggctacgttatttcgaaaaacccattgccggatactggattaacagcattgggcaatggctatttggcgcgaataactttggtgtgcgggcaggcgttatctttgcgaccctgttaactgccgcgctggtgacctggtttactctgcgcttatggcgcgataaacgtctggctttactcgccacagtaatttatctctcattgtttattgtctatgccatcggcacttatgccgtgctcgatccgtttattaccttctggctggtggcgggaatgtgcagcttctggctggcaatgcaggcacagacgtggaaaggcaaaagcgcaggatttttactgctgggaatcacctgcggcatgggggtgatgaccaaaggttttctcgcccttgccgtgccggtattaagcgtgctgccatgggtagcaacgcaaaaacgctggaaagatctctttatttacggctggctggcggttatcagttgcgtactgacggttctcccctggggactggcgatagcgcagcgggagcctgacttctggcattattttttctgggttgagcatattcaacgctttgcactggatgatgcccaacatagagctccgttctggtactacttgccggtcgtcattgccggtagcctgccgtggctgggattactccccggtgcactgtacgctggctggaaaaaccgcaagcattccgcaaccgtctatttgttgagctggacgataatgccgctgctgtttttctccgtcgctaaaggcaaattgcccacctatattctttcctgctttgcacctctggcaatgctgatggcgcattacgcattgctggctgcaaaaaataatcctctggcgttgcggattaatggctggattaatatcgcttttggcgtcactggcattattgccacatttgtggtctccccctggggaccaatgaacacaccggtgtggcaaaccttcgagagctataaagtcttttgtgcctggtctattttttcgctatgggcatttttcggctggtacaccttaacaaacgtcgaaaagacctggccttttgccgcgctttgcccgctggggctggcgttgctggtaggattttcaattcctgacagagtcatggaaggaaaacatccacaattttttgtcgagatgacacaagaatcacttcagccaagccgctatattcttactgatagcgtcggtgttgccgcaggtctggcatggagcctgcaacgcgatgacatcatcatgtatcgccagacaggtgagttgaaatatggccttaattatccggatgcaaaagggagatttgtcagcggtgatgagttcgcaaactggcttaatcaacatcgtcaggaggggattattacactcgtgctttcggttgaccgcgatgaagatatcaatagtctcgccattccgcccgcagatgtcatcgatcgtcaggagcgtctggtgctaattcagtatcggcccaaatgatctggctaacattagtctttgccagcttgcttagcgttgccgggcagttgtgtcagaaacaggcaacctgctttgcggcggtaaacaaacggcgcaaacatatcgtgctgtggctgggactggcgctggcttgtcttggccttgccatggtgctctggctgctggtcttgcagaacgtaccggtaggcattgcctacccgatgttaagtctgaattttgtctgggtaacgctggctgcagtaaaactgtggcacgagccggtatcgctgcgtcactggtgtgggttggcgttcattattggcggcattgtgatcctcgggagtacggtgtaatgggcctgatgtggggattattcagcgtcattatcgcctccgctgcgcaattaagcctgggttttgcggcgagtcatctgccgccaatgacgcacttatgggattttatcgcggcgctgttagcttttggcctggatgcccggatactgttactcgggctgctgggttatctgctttccgttttttgttggtataaaacactacataaacttgcgctaagcaaagcctatgccttgctcagtatgagttatgtgctggtatggattgcttcaatggtacttcccggctgggaagggactttttcgctgaaagcactactgggagtagcctgtattatgagcgggttgatgctgattttcctgcccacaacaaaacaacgttactgagttttccctgccgctttacactgccgttcccactcatcggggctataacagcttgcagaaagaactttcaccgtgtgcagcttttcacgattaatacagtaaagcgcattctgcaaaggcgagagtaaatcccccactttcacggcgaagtcactcttcacttcggcgatcatttttatcgcgccgccagcatcgcagagcataattacatgtctgttatcttgtttattgcagcacgtttttttgaccagccattccattgcattatcctgtttgctaagagttttcacatcaatttacagattaacagataaactctttatcaacggcaatggaatggcagaaatgagaagtgaaacggagggttaattattgctggcgttgcacccactcttttagcgcctgacgtgaaattttaataccgccgtttttcagctccggcggcagagtcagccagcgcaccggttgttgaaaacgagccagcttatctttcacccattcgtcaagatcaacgctttgctggtcatactccaccaccgctaccggccgatgaccaaactccttgtcggcaacgggaacgataaacacctgcaaaaccgcaggatgtgcagcaataacacgctcgacttcttccggctgaataccctcaccaccactgaagaacagattatctaaacgtccgacaatggtcagcttgccattatgcatctcaccgcgatcgcgcgtggcgtaccagccttcgtcattaaccagtggaacccgttgcccgttacgccagtaaccttctgccatactggcagcccgcagccacacttcatcattaacgattttcacttcccgacccggcagcggcgaaccaacgtctgccagaccgtcggcttctttcgcacacactgtggaggcaaactcggtcagaccatagccgcaaaagcaccgaatcccctgctcgcgcgcctgttccgtcaactcgaccgggatagccgcgccgccaagtaaaaccgctttcagggaaacggaactacggttaaccagcaaacgccagagttgtgttggcaccagtgaagcgtgagtacagcctgccagcatctgctccaatggctgtttatcacgcaccgtcatccgcgcaccagcgtataaccagcgccacataattccctgaccggagacgtgaaacagcggtaaagagagcaaccagtcatcgtgatcgccaaacggaatcagcgataacaccccttcggcgctgacaagatgagcctgataagtatgaacagcggctttcggcaagccagtggaaccagaggttaacgtcattgagcacagacgcgtcggctgccacgccgcggcatgtgcgccttcaaccagctgaatgtgcagcgacgctaacgccggaaacgtgttttccccttccggcaccagcgcaaattgcagcgtaagattgggcagcaattcctcaagcagcggttgcggcagctgagggttcacgggcaacacccgcgccccgcattgcagtaacgccagccaggccagcagcgtttgcggcgtattccacgcccgcaacatcacgccgctgccctcaaccacaccctgcatcgcaaagctggaggctaattcatcgacgcgagcacaaagctcgcgccagttgagttgctcgtcattaagacgtaaggcgatggcttctccccgcacttgccgccagtgacgccacggccagtcagagaagatcataacagccgctccagtgcatcaacgtccactaacggcagtgggctccccggccagcgacgaacctgctgcgcttgcatcagatccagcgtgtccagtcccggaatggtgtctggcgttaaccaggcagcaatccgcgccagttgcgttagacctaagctcgactcaatggaagaactgatcaccgccgtcagccccagcgcatgcgccgcctgcacttgctcgcgtactttatccaggctgcccgtgagcgtgggtttgataactaccgcgcgcacgccctcttcagctacaaaggcaaaatccggctcgcgcaagctttcatcccaggcaatggcaatgccggtttcacgggcaaacgcacgcgaatcatcgcgggttttgcacggctcttcgagaaacgcgatgcggtggcgataatccgggttaacgtatttggcaaactgctggcctttcagcggtgtccaggcgcggttcgcgtcaagacgcaaatgcagatcaggaattgcctccagcaacagattcaccaccatgccgtcgcgcacggcttcgtacaatcccactttgacctttgccactttctcgccaggcatatcggcaagtttgaggatcagatcgtcaggatcgccattacacagcggtgccgcacggtaattggccgcctgcgggagcgtatctgccagctccgccaatgcacaacttacgccaaaggcaacggaaggcatctgcggtaattcgcaatcgcctgccagccagttatttacccaggcaagcagcacactttgcgcatcttcccagctttcctgactgaagcccggcagtggggagatctccccccacccttcgcgctcgccctcacgcaggcaaacatacagcccgtcgcgggtttttaaccgcctgtcgcgcagaaccacccccgcgtccatggggatctgccagcggtatacctgcgcgctacgcattacggattccgtttaaatttgctgaaatcaggctgacgtttctggttgaaagcattgcgaccttcctgaccttcttccgtcatgtagaacagcatggtagcgttgcccgccagctcctgcagccccgcctgcccgtcacagtcggcgttcagcgcagctttcaggcagcgcagcgccatcgggctgttttgcagcatttcacggcaccaacggacggtctctttttccagatccgccagcggtacaacggtgttcaccaggcccatatccagcgcctgttttgcgtcgtactgacggcacaggaaccagatttcacgtgcttttttctgcccaacaatgcgcgccatataggaagcgccccagccgccgtcgaaggaaccgactttcgggccagtctgaccgaagatggcattatcagccgcgatagtcaggtcgcacatcatgtgcaggacgtgaccgccaccgatggagtagccagccaccatcgcgacaaccggttttggacaggtacggatctgacgctggaagtccagcacgttcaggtgatgtacgccggaatcatctttatagccgccgtaatcaccacgtactttctggtcaccaccggagcagaacgctttatcgcctgcaccagtcagaatgatcacgccgatgttgtcgtcataacgcgcatccgccagcgcctggatcatctcttttaccgtcagaggacggaaggcattgcgcacctgcggacgattaatggtgatttttgcgataccgtcggtggatttttcataacgaatgtcctcaaaaccttcggagcagtcgtgccattcaaccggtgcgtaaagcattgcttcatcaggataaatcatattgtgtcctttagtcagaaacgcaagatctgcgccagacttgcgattacgccagcgggattttcccggtgcgcgttatgtccggcgcgaggaatgacatggcagtcggcagccagttccgccgccagagcgcggaatttgctgtcacgttcaccacataaataataaaacgcaaatgtgcgggcgctaaggttagcacgtaaatcgggctggacggcgagagaagtcgcctccagcatggcggcaagggttgcgccattattgttgctgcgcagcgccaccagctcccggcgttgatcgtcattgagcgaggcaaaaacaggctgttgataccaatcggcaaataccgccgttaacggttctgtacgaaaacgctgcgcccattggcgatcggaacgctgacgttccgcgcgttgttcagcattttgcaacccaggatgcccgccttcgacaacaactccacaaagccccgccagctcctggcaagccgccatcatcgccacccgtccgccaagcgagtaccccaccagccagaagttaaggatgttgtaactaaccagagttttacacaataagccggtgacatcatcaaatccatcgacgctgatcgtcgctgaaccaccgtgacctgggagatcaacatacaaccgcgagtagtcggcaaacgcctcgcccacttcttgccattcatggcaatcgccagaaaaaccgtgcaaaaacaccaaccagggtaaacctggtttgccgtgttttgcctgcgcgtgcaggatcataaatggcttacctgcgccagaagttgctggagcgtttgcgcaccatcggtgtcgttaaccaccatttcaatcaccgtggtggtcggcgtacgccaggcatcgactagtgtcgtttcaagttcctgccagttttgcggacgatgatatttcagctcgaacatcgcggcggcgtgctcaaaatggacgttttgcggcatcagatagaaacgctcgcgctcgcttttcggcgttggcaacagcgaaaaaatttgcccgccgttgttgttcaccacaattaataccagcggtgcggaaacctggcgcaataacgccagcgcgttgagatcgtaaagtgcggagagatcgcccacaatcgccagcgtcggtttgccgcttgcccgctgaacgccggcggcagtcgagagcagcccgtcgataccgctggcaccacggttgctgtacaccgggtaacctgccggaagttgcgaaagcgcatcaatcagacgcaccaccaggctgttaccgacaaacaattgcccctgttcaggcaagtagtcgctgatgcgatgcgccagttgcgcttcgccaaacgcatcgcgacgggcaataaccgcctgcattgcctgttccgccaggcgcgggatttcaacgcaccagggctggcgtttttctgccggatgcagctccagccagtcggcaatattggcaattaagcgacgtccgcgatggtgtgccggatcaagtcgcccttcaatgtcatcaacaatccagtactcttctggttcacagcttgcctgccattggaggagtcgtttccccgtcaggctgcttcccagttgcaccactatttgtgcctgttgcagttcgctggtcgctttggcattgcctaaccagagatcggcacacggcagcggctgtccggtttgcgacagcacgtcgccaatcagcggccagccaagagtttgcgcccacagtgcaacttttttgccctcttccgcactcatgcgcccggcaaccaccacgccgcgcttttgtcgccagaagaaccagtcacgctgtttttcactttcccgacgaggcgcttcacgcagccacggtttgtcgtcctgccaccagtcgcccagccgctgttgccagctaatcccggtgtcgtccatttcgccatacagcggttcagcaaacgggcagttgatatggactccaccagcatgaagcgtaccgagagcgtggtcgatggtagaaaccagccaacgtgcggggatatcctgggtcgggcgcggcagtgaaatactgtgcgtggggtgagaggcgaacattcccggctgacgaatcgcctgattcgcgccgcagtcaatcagctccggcgggcgatcggcggttaacaggatcagtttttctccggttaacccagcttcaatcagtgccggatagagatttgctaccgccgtgccggaggtcacaatcaccgccacaggctgcttgctgactttcgccagccccagtgccagatgccccagtccacgctcatcgaaatgggtatgatgaataaatgcggaattctccgccgccgctaacgttaacggtgtagaacgcgagccaggggcgatacagatgtgtctgacgccgtgacgcgttaatgcttccagaatgaccgccgcccagcgtcggttaaatgcgcttactgacatgagtttgtccggtatcaatattgcggctaagtataaggagctacaaaaatagattattgatatgaatcggtaatgatgcgactcattactattccatttgtaataaagtacgcagccctgccgctttgttgtcgatttcctgccactcttgctcggggtcggaaccacggacaatgcctgcgccagcatatagccgcacgatattgccgctgatttttgctgagcgcagggaaacgcagaattcactttgctgtaatgagagatagcccgcagaaccggcgtaccattctcgagtgaacggttcgtgacgggcgataaactgtcgcgccagatcgcgcggtaagccagcaactgctgccgttggctgcaactgatgtaaacagatcacatcatccgctttgttgagtgaagtccagatacagcggcgaagatgctgtactttacgtagacgcagtacctgcggcggtaaaacatccagcgtttgggtatcggcctgcaatcgttggcagatatcttccaccaccaacatgttctcgcgctggtttttatcatccgccatcagccactcacctaactgctgcgcctgcttatcatcaggatgatttgctaccgttcccgccagcgcttcggtacgcagcgctttgtcacgccgccgccataaccgttccggtgaagaaccaagaaaagcattttcgccatcaaaggccatgtaaaaatggtagcaattcagattgagccgacgactggcagccatcatcgctgccgcattgaccggacttgcgaaatgcaggtcggttgcccgagcaagcacaactttgtcgagctcgccttcggcgatggttttcgttgccagttcgattaattgcgtccagcccgttttgtccggccagtgttgttctcgcgtggtggttaaatgtaatccaggcaggggcttgatactcaccagtgtggcgataaattcttttgccttgattgcatcgtgctgaagggagctttcgctgaatagcgtcagccgcagcgtggctttaccgccacaacgtcgccattctaggcgtggtaaaagtaaattgccctgcgacgggtcaaacgcattcaacccccagatgcgtaagtcggcgtgttccgggtgctggcgaagaaaacgttgtgcctggtccaacgacgtaaaacgggtaatcgcacccaggacggcagcttcttcatcaccattacgttgttgccagtagaattgcggatacacctgctgactggccagccagctcaaggcatcaaaagcgtctttgagagggaaaggaatatcgataacccgaatgccgggtgtcgccggaatctcttgcgacaaatggcgcagtagattttccagcgccgtagtaagtgattgcacgcggacctctccctgttaaaagcctcacattatacggggtacgacaaaaaaaatgcagtaccccggtgtagggaggttttaacggcgtgccagcaacagtcctagaaccagcccaacggccgcacccacaccaattccttgccagggtttttcgtggacgtagtcatcagcacgataaacagcctgcttcgcccgatagtaataactgtctgaagcctggctaacccgttttttcacatcatccagcgctttttctgcacgcgctttcagctcaacatatttctgatcggcgggatcgccagaggagcggagcacctcttccagtgtttcactaagcagcgtcaggtcatcatcaatacgtgtatcaccaaactgattagacattctcgttctccatttgtgtaaaacctgtcactaactatagacaagggttattgattacgcctgaattacctcgcgtgccatcccaatgtgtgggataccatcttcttcataaatatcggtcacagggatgaaaccaaattgcccataaaagttttgtaaatgcgcctgcgcccccagataaatcggcttctccggccagcggcgagtacacgattccagcgccttactcatcaattgctgaccgattttttcaccgcgtaaggcttcgctgacaatcacccgaccaatcacaacgggttgcagttcgtcgtcacttttcagaatcctcgcatacgccaccagtgtcccgttatgccaaccgagaatgtggcgattgtctccctccagatcgtcaccatcgatatcctggtaaggacagttttgttccactacaaataccgcacaacgcagttgtaataaggcataaagctgagaaacggataaatcagaatgatgcagatcttgccagtcgatcatggaaggctcctttgtgctgtttgctttatactagccggaatattttcagcagcgcgatgaactcatggaattaatttttttaggtacttcagccggagtgccaacccgtacgcgtaatgtcacggcaatattgcttaacctgcaacatccgacccagagcggactttggttatttgactgcggtgaaggcacccagcatcagctactgcataccgcctttaaccctggaaaactggacaagatttttatcagtcaccttcatggcgatcatctctttggtttacccggcttactgtgcagtcgttctatgtcaggcattatccaacccttaacgatttatggtccgcacggtatccgtgaatttgtggagaccgcgctgcggattagcggctcatggaccgattatccgctggaaattgtcgaaattggcgctggcgaaattttcgatgatggcctgcgcaaagtgaccgcttatccgatggaacacccactggaatgttatggttatcgtattgaagaacatgataaaccaggtgcattaaatgcccaggcattaaaagctgctggcgtgccgcctggcccgctgtttcaggaattaaaagcgggcaaaacaatcatgctggatgatggaaggcagattaatggcgcagattacttagccgctccagtgccgggtaaagcgctcgctattttcggcgatacgggcccctgcgatgccgcgctggagctggctaaaggcgtcgacgtaatggttcacgaagcgactctggatatggcgatggaggccaaagccaacagtcgcggccatagttctacacgccaggcggcggcactagcccgtgaggctggagtcggtaagctaatcattacccacgtcagctcgcgctatgatgacaaaggttgtcagcacctgttacgtgaatgtcggtcaattttcccggcgactgaactggcgaatgatttcgcggtgtttagcatttaagtcgaaagcggtggttagttagcagattaatttaacgataccaacgcatttatttgacattttttcatctgtttgccggatacgtttgatgtcgatatcaggcaaacagaattatcatttttagttttgtgaattgtccagatctttcgccagtccaatcaggcgaataaattccgctctgtaaccctgtggatcttccccttttgccttctgagcccactgtttgatctgctgccaggaggtattgttcaggtattcagaaccgcgtaacttttgcccatatgcagccactgctgcgcgaaagcgcatatcttctgaaggtgcctttattgcagatgccaacgggaattcaactaactgactttcttttccctgtggggatttccaacgaatctttaaccaggcaagttcttttgttttgtccgatttcgctgatttgttatccggggcatagcgtaacttatcaattgatgctttttgccctttcagcgttaattcaaataacaatgttatatgtttacctgcgccaatatcacccgcatcaacgttgtcgttattaaaatcctctgccttaagttggcgcttttcataacctatctgacggtattccgttacccacgcggggttaaactcaatttgcgctttgacatcttttgctacggtaatcaacgtctgccgcatttcactgttcaacactttctgcgcctctgagagggtatcaatgtagctatagttgccgttaccaacatcggcaattcttaccatcattgcctcgttataattgctatcccccacgccaagcgtcgacagagtaacaccggactcacgctgttttttgaccattgattcaatcgattttggatcgtcaatgccaacgttaaagtcaccgtcagtggccaataaaatgcgattgataccacctttaataaaccccttcgctgcctgctgataagccatctccagcccggcaccgccattggtactgccttctgcatccagcgaatcaattgcagcattaatttccgccttgtgactaccggagatagaaggcaacgcaatacgagagtcgccagcgtaggtcacgatggcaatgttatcctgctcacgaagttctttgaccaataatttcaacgaagactggataagtggcaaacgttcatcagaaatcattgaaccagaagtgtcgataagaaagaccagattagaagcgggtaactcttcacttttgcgatctttcgccaggatatcaactttcagcaatgttcgctgttcattccagggtgcaggtgccaattcgtagcgcatagcgaaaggtattggcttagaggccggaatagattgtttgtctttgatatcccagtcagacgggaaataattgactacctcctccacccgcacagcgtctggcggaggtaacagcccttgattaaggaaacgccgcacattcgcataactgccggtgtcgacgtcaaggctaaacgtcacgagtgggttttgcgctacctgcttaatcggattatcatcgaactgctggtagcgagcggttcctggatttgcgatttgggaggctgctttttctctggctgcatgttgatactttggagccgcctgcaatcgccccagcaaagcctgtttgtctgaatattgttgcacttcttgctgggctaaggctttcgcgtctgcagcggctttggcggcgctttgctcagccacttttgttgccgcttgttgcgcggcaagcacttgctggtcagtgggtgtagtagattgttgttgctgacttttcttatcctcaggttccggcccacatcctgacaaaatcaaactacttataagcaacatgattatatttttatttcgcatataaaatccttttaaataaattcagggccccgacataaaatacactctttgtataatcctgctaatcttaataaaatacaatatcgaaacccataacaaataatgattcaacaacgcaacccattaataatttgcatatgaaaaaaataaattttgcttttattatattatttctgttttcactccctctgattattttttaccaaccctgggtgaatgcattaccgccaacgccccgacacgcaagtcctgagcaattagaaaaaacagttcgttatcttacacaaacagtgcatccacgtagcgccgacaatattgataatctgaataggtccgcagagtatataaaagaggtctttatcagtaacggtgccagagttaccgcgcaggatgtccccattacgggtggcccctacaaaaacattgttgctaattatggtcctgccgatggaccgctgattattattggtgcgcactatgactctgtcagtagttatgaaaacgatcaattgacctatacgccgggcgcggatgataacgccagcggcgtggcaggattactcgaactggcacgtttgttacagcagcagactccagggattggcgtccaactggtcgcctatgcgtcggaagaaccgcccttctttcgtagcgatgaaatggggagcgcagtacatgcagcttcgcttgagcgtccagtgaaattaatgatagcgctggagatgattggttattacgactcaacgcctggtagccaggattacccatccccggcaatgtcctggctttatcccgatcggggagactttattgccgtggtcggcagaatgcaggatatcaacgccgttcgtcaggtaaaagcggcattgttgtcatcccgggatttatctgtttattctatgaatgccccaggttttattcccggtattgatttctctgatcaccttaattattggcaacacgatattcccgccgtaatgattactgacaccgctttttatcgtaataaacaataccacttgcccggtgatatcgcagacagattaaattatcagaaaatggctcaggtagtggatggagttacaaccttgttatacaacagtaaataataaaaatttctcgaggcggatccagaaaaagcaacatgcgcattttattttctttcgtctgttttaagatgcgaaacatgaaactcaacggaggaaaaataaatgggaatgattggctattttgcagaaattgactcagaaaagattaaccaactgcttgagtctactaaaaaacctttgatggataatatacatgacacgctttcaggattacgccgactggatattgataaacgctgggattttttacactttgggctgacaggcacctctgcttttgatcccgcgaagaatgacccgctgagtcgcgccgtgcttggtgaacacagcctagaagatggcatagatggcttcctgggattgacctggaatcaggagttagccgcgacaatcgaccgactggaatcactggatcgaagtgagctgcgtaaacagttttccattaagcgactcaatgaaatggagatttatccgggagtaaccttttcagaagagttagaggggcaactctttgcttcgatcatgcttgatatggaaaagctgattagcgcgtatcgacgtatgctgcgacaagggaatcatgcgctgacggttattgttgggtgatggtgtcagggcaccaaaaaaaaccgccgaacatgtcggcggctttctgacttacaaactgactgtttacatcagcggcattgctaaccgcacaatgctaatcagcggttgtggccatacacccagcaccagtaccaacagtgcagagatcagcaccacgataccgcctgcgctgtactgccagtttgatggtgcatcgcgacccggttgttccggagcgtgcaggtataagctcaccgccacgcgcaggtagtagtaaaggccgattgccgaaccaacaaccacggcacccaccagccaccacaagtgtgcctggacaccgaccgccagcacgtagaacttaccgataaagcccagcgtcattgggataccagccagtgaaagcatcatcaccgtcatcactgccgcgaggatcggacgatgccagaacagaccgcggtaagagaacagggaatcagcatccgggccacgatacgggctggacatcaggctgaccacgccgaacgcgccgaggctgctgaacagataaccgaccaggtaaacccctaccgcttccatcgacatctcgccggtttgcagcgcaatcagcgccaccagcagatagccgaggtgagagatagatgagtaaccgagcagacgtttgatattggtctggctcagcgccatcaggttaccgaagatgatggaggcaaaggcgataatcgccagcactacgcgaatcgcttcactgtcacccaccggtgcgtaaaggaacaaacgcatcaccacgccgaagatagcgattttgctcgccgtcgccaggaaagtggaaaccggcgcaggcgcgccctggtatacgtctggcgtccacaggtggaacggcaccagagagagtttgaaaccgaggccaacaatcatcaggccaaaacctgccagcaacagcggctcgttgagcataccgtcgccgagttttttacccagtgcgacaaacgacaggtcgccagactgcgcatacaccagcgccataccgaacagcaggaaagaagacgctgcggcagaaaggatggtgtatttgatactggcttccagcgaacgtttctggcggaaagcgtaaccgaccaggccaaacagcggcaaagagatcagttcgataccgaggaacagagacgccagatggttggcattcgccagcaggatcccgcccagcgcggcaattaacaccaacaggtagaactcgtccttgttgtcgttatagccttcaagccacgggtaggcgaaagtacaggtggcgaggctcgccaacaataccagcccggtgtaaagcatggcgaaaccatcaacgcgcatcagcggcgtaacgtccatagcgcccgcctggccgacaaaccagagcgaaaccagcgccgcgttaagcccaataaccgagagcgtagcgttgaggaaatgattgcgtcgccacgcaatggagagcatcacaaccaccaccgtcaagccgacgatcagcaacggtagcagtgcgatcaggttttgtggagttattgtcatggcgatttacggccttgtagtagtaacggaattaacaaaccactgctggatattgccaatcgcggagtacgaggtatccagaatcggctgcggatagaagcccagcagtaccagcagcaccaccagcaacaggatcataaacagctcacgcagcgacatccctggcagttcctggctggcaatctggcttttcgctttgccgaagtaagcgcgatgcagcatcgccagcgaataaacagatgcaaagaccagcccaaaggtagagataacggtaatcaccgggacaacctggaagctgccgaacagaatcataaattcgccgacgaagttaccggtgccaggcatcccaagcgttgccaccgcaaagaacagcgacagtgctggcagccatttcattttgctccacagaccgcccatcatgcgcatgtcgcgggtatggatacgttcataaagctgaccacaaagaataaacagacccgccgccgacaagccgtgcgcaatcatctggattaccgcgccctggtaggccaactggctgccggtgtagatagcaatcagcacgaagcccatgtgggaaaccgaggtgtaggcgatcagacgtttgatatcggtctgggcgaaggccatccacgcaccatagaagatgccgataacacccagccacatggcgattggcgcaaactctgccgacgcgttcgggaacagcggcaaggagaaacgcaacagaccgtaagcggcggttttcagcaagatccccgcgaggtcaacggaaccggcggtcggtgcctgggagtgcgcatccggtaaccagccatgcagcggaaccaccggcattttcaccgcgaaggcgatgaagaagcccagcatcaacagatattccacgccgttagacatcggcgtattcagcagctcttcatagttgaaggtccagacgccggtcgcattgtagtgaacgaaaaccagcgccaggatggcgatcaacatcaccagaccactcgcctgggtgtaaatgaagaacttggttgccgccgtgatacgcgttttaccgtcagaggctttatgcccccacagtgcgatcaggaagtacatcggcaccagcatcatttcccagaagaagaagaacaggaacatgtcgatggcaaggaacacgccgataacgccgcccaggatccacatcaggttgaggtggaagaagccctgatatttttcgatctctttccatgaacagagtaccgccagcacaccgagcagaccggtcagcacgaccatcagcaacgacagaccgtcaatggcgagatgaatagagataccaaaacgcgggatccacggcatgtcgaattcagactgccactgcggaattccggcggattgcgtcagtgaataaccgccctgcaaccacagttgcagcgacagcgccagcgtcaatcccatggttaccagcgcgatccagcgcggcaccttgacgccaaagcgttcggtctgccagcacaggaagccgccgataaagggaattaatattagccagggtagtaacatggcgatctttattccttgtaaaagtcccgtcaggaccggattttcaacgaattctcacgacagaaaattctcttcggactgggggtagtgtcggatgcgccgcgaagacggcttatccgacctacgttcttatatgcccaggggcaatcccacaatccttaactcaacgcagtaccatcaacagtgccagcaccacgaccgcaccgatgctcatggatgccacataccagcgcagataaccgttctcgcttaacagcagacctttacctgcaaagcgggaaaggacagccgggatgttcatcattgagttcagcggatcgcgtttcagcaaccaggcaatacccaggaacggcttgacgaacactttgtcgtacagccagtcaaagccccaggcgttgtaccaccaggtgcccagcagacggcccggcgaactgttggcgatggaggtcaccagagtacgtttacccagccacagccaggcagccagcagaatgccgaccaccgcgaccacgccagaggtaatttccagggtcaacatgctgccgtgcgccagctccgtcgtttgcggaagcacgccctgcagcggcggtacaatcagtgcgccaacgaaggtggaaaggatcagcagcacaatcagcggcaggctgtgagttacccctttcacggcgtgagcgtgaatttgttcttttccgtggaagacgatgaaaatcatacggaaggtgtaaagcgaggtcataaacgcaccgaccagacctgccaccatcagattgatatgtccattcgccatcgcacccgcgaggatctcatccttactgaagaagcccgcagtgaccagcggcagtgccgacagtgctgcgccgcccaccaggaagcagagataaaccagcggaatagatttacgcagaccacccatcttaaagatgttctgttcgtgatggcaggccagaatgacggaaccggatgctaggaacagcagcgctttaaagaacgcgtgggtcatcaagtggaaaatcgccgcatcccatgcctgcacgccaagcgcgaggaacatgtagccaatctggctcatggtagagtaagcgagaacacgtttgatgtcggtctgtaccagcgccgcaaaaccggccagcagcagcgtaaccgccccaacaatgcccaccagatgcagaacttccggcgtcatcaggaacagaccgtgggtacgggcgatcaggtagacacccgcggttaccatcgttgcggcgtggatcagcgcggagacaggcgtcgggcccgccatcgcgtcggcaagccatgtctgcaacggcaactgcgcagatttaccgaccgcaccgcccagcagcatcagcgtcgcccacatcagcatgttattgccgtcagcaaagtgcgctggtgccagttccaccatttcgcggaagttcagggtgcccagttcgttgtaaagaatgaacagcgcgaaagcgaggaagacgtcacccacacgggtcacgacgaacgctttcattgccgctgcgccattcttcggatcggtgtaatagaaaccgatcagcagataggagcacaggcccacgccttcccagccgaggtacatcagcagcaggttgtcggcaagcaccagaactaccatgctggcgatgaacaggttggtgtaagcgaagaagcgagagtagccctcttcaccgcgcatataccaggaggcgtacatgtgaataaggaaacccacaccagtgaccaccgagagcatggtcagcgacaggccgtccagcaccaggttaaaaccgatgttaaagtcgcctaccgacatccacgtccacagcggctggctgtatgcctgctcaccgttagcgaagaagtcaacgccgataaaggcagttaccagcgccgccaggcccacagagccaacgccgacgatcgccgagacgttttcagaccagcgcccacgggagaacgccagcaggacgaagccaatcaatggcaaaataatggttaaggcaagcatgttcatccgcgcatctcacttactgaatcaatgttcaggttctggcgacgacggtgaagttgcagcagcagcgcaaggccgatactcgcttctgccgccgcgaggctgatggcgagaatgtacatcacctgaccgtcggtctggccccagtagcttccggcgaccacaaaggccagcgcggaggcgttaatcatgatttccagaccaatcagcataaacagcagattgcgacggataaccagaccggttaagccaagaacgaataagattgccgcgaggatcagtccatgttgtaaggggatcatgcgtgctcctccgtttttcttttcgcgctgtcgtctttacgattgctcagcacttcacccgcacgctcttcacgaccaacgtggaaggccacaaccagacccgcgagcagcagcatagaagccaattccaccgccagtacgtaaggcccgaacagcgtaatacccactgctttagcactgattggcgtaccgtcgataccctgatcgttaacaccgagaatggcgtaaacaatcaccaccagcatgatggctgacaaaattgccggaccaatccacacctgcggtttcagccactggcgttcctgttcgatttctgaaccgcccaggttgagcatcatcaccacgaacacgaacagcaccataatggcacccgcatagacgataatttccagcgcaccggcgaagtaagcgcccagtgagaagaacaccccagagatcgccagcagcgaaataatcaggtacagcagcgcgtgtaccggattggtatgggtgatcactcgcaaggtcgcaagtatggctatcaggccacagatataaaaagcgaactccattgcccctctccttacggtaacaggctcttgacgtcgataggcttggcttcgttctctgcttcgcccttatctttgccgtcgattgccatacctgccatccggtagaagttatattccgggtatttgcccggaccggagatcagcagatcctctttctcgtaaaccagatcctggcgcttgtattcccccatttcgaaatccggggttaactgaatcgccgtggtcggacaggcttcttcgcacagaccacagaaaatgcagcgtgagaagttgatgcggaaaaattccggataccagcgaccgtctttggtttctgctttttgcagcgagatacagccgaccgggcaggctaccgcgcagaggttacaggctacgcaacgctcttcgccgtccggatcgcgggtcagaacgatacgaccacgataacggggcggcagatagaccggctcttccgggtacattcgcgtttcgcgtttggcgaacgcgtgcaggccgatcatccagatactacgaacctgggtaccgaaacctactaacaattcttttaaggtcatggtcttattgccccttattgcgcctgccagagaatgacagccgccgttaccagcaagttgatcagcgtcagcggcaggcagattttccagccgaaggacattacctggtcataacgcggacgcggtaacgacgcacgaatcaaaatgaacatcatcataaagaacgcggttttcagcgcgaaccagatgaatggcggtaacaacgggccttgccagccaccgaagaacagcgtcaccatcagtgcagagatggtcacaatcccgatgtattcgcccacgaagaacagaccgaacttcataccggaatattcaatgtggtaaccatccgccagttcctgctcggcttccggctggtcaaacgggtgacggtgacacaccgccacgcccgcgatggcaaaggtaataaaaccaaagaattgcgggatgacgttccacacatgcgcctggctgttgacgatgtcggtcatgttgaatgaaccggcctgcgccaccacgcccatcagggaaagcccgaggaacacttcgtagctcagggtctgcgcagaagcacgcatcgcccccagcagcgagtatttgttgttacttgaccagcccgcaaacagcaccgcgtaaaccgccagacctgccatcatcaggaagaacaaaatcccgatgttcaggtcggcaaccacccaacccggactgactggcacaattgcaaaggccagcagcagcgaggtaaaggcaatcatcggtgccagggtaaagatgacacgatccgagaatttcgggatccagtcttctttaaagaacattttgatcatgtccgcaaccagctggagcgaaccgccccagccaacacggttaggtccataacggttctggaacagacccagcaggcgacgttcgccaaagctcatgaatgccccacaggtgactaccaccagcaggatcaccaccgctttaaggacggtcagcaggatctcaatcagttccggtgatatccaactcattgttgtgcctccttgagatcctcaagatgcgcgccagccagcaccggagcaatgccggacatacccatcggcaagcccacctgccctgctgtcagcccttcggcgatttcaaccggcagcgtgaccgtgttgccatcgtaactaaaggagacgcgtgtacctgcgttcacacccaacttcgcggcatccgctgggttgagtttgatgtacggctgcggcatacggctctggaagaccggagcacgctgtgacaattcatcgctgccaaacaggtggtagtacggcgcgatacgccatttcccgtcctgcggctggaagcgtgccggtacgctggtgaagtaatccagaccgttttcgctggtttcaaacagacgcacgcccggatcgccaaaacgcagtttgccgcccacttcgtcctggaatttgttccacgcctgcggggagttccagcctggcgcccaggcaaacggcacttgcgaacggtgcgcggtcggctggttgttaccttccatcgagaaggtgaacatggtgtcaatatcctgcggctgacgcggctcatgaacgctgatattggcgcgcatggcggtacgaccgctatagcgatgcggttcacgggccagtttctgcccacgaatacggaatgtcgcatccggcgcagcatctttgatacctgccagttccgggattttcgccacaacagcgtcaatcacgtggtcgagctgcgtccagtccacttcacggctcagcagggtgctatgcagcgagtgcagccagcgccagctttccagcatgacagtttggctgtcgtaataagccggatcgtaaacctggaagaaacgttgggcgcggccttcgttgttgatcaccgtaccgtcgctttcagcaaagctggcggcggaaagtaccagatgagcgttttccataatcgctgtgcgttgatggtcaaccaccatcaccagcggcgctttagccagcgcagcattcacgcgggtagcggaagcgtgacgatgcagatcgttttccagcaccaccaccgcgtcggcgcgtccggtttccagttcagttaacgcttcttcaagcgatccaccgcctataatgcccagccccatgctgttgacggaacgggcaatcatggtgataccgacgtcagcgccgcgacctttcagggctttcgccacgttagccgcagcctgaatcacttcagcgctaccagcgttcgtcccggagataatcaacggtttcttcgcaccagccagtgcctgcacgatgacgtcgattttgctttgcagctcaggctctatgccgtcaactgccggtgcggagttgtccagcgcatgggcgatggcaaaacctaaacgcgcctgatcttcaaccggtgcgcggtaagtccacgccacgatatcatccagacgggtgtcatcaacgttggtaacaaacagcggatgcttcgcacgttgaccgatgttgaggattgccgcaatctgccagtcagccactttctgtgctgccgccatttcgcgcgctttaccttttaccgcctggcgcaccgccagcgcaacgcgcgcgccggtctgggtaacgtcttcgcccagcaccagtaccgcatcgtaagattcgatttcgcgcagtgccggcgtataaatgccgccttcacgcagtactttcagcgccagttgcagacattcctgctcaccgtgagcgataccggtatagaagttttcttcgcccaccagctcacgcagcgcaaagttgctttccacgctggcacgcggagaaccaataccgatgactttcttcgactgacgcagaatatctgctgcgccctgcattgcctgttcggcgttgagggtaatgaaatcatcgccacgacgctgtactggctgacgcggacgatctttcaggttgacgtaaccgtaaccgaaacgaccacggtcgcagaggaagtaatggtttaccgtaccgttgtaacggttttcgatacgacgcagttcgccataacgctcgccggggctgatgttacagccgatggaacattgctggcagatgctcggcgcaaactgcatatcccatttacggttgtaacgctcggagtgcgttttgtcggtgaatacgccggtcgggcaaatttcgaccaggttaccggaaaattcgctttccagcgtgccgtcttccggacgaccgaagtagacgttgtcgtgcgcaccgtaaacgcccaggtccgtaccgtcagcgtaatctttgtagtaacgcacacagcggtagcaggcgatgcagcggttcatttcgtgagagatgaatggccccaaatcctgattacggtgggtacgtttagtgaaacggtagcgacggaagctgtgtccggtcatcacggtcatatcctgaagatggcagttaccgccttcttcacatactggacagtcgtgcgggtggttggtcattaaccactcgaccacactttcacggaactgtttcgcttcttcgtcgtcaatggaaataaaggtgccatcggaagccggtgtcatacaggacatcaccaggcgaccacgcgtgtcttccgcgttttggtattgcttcaccgcacactggcggcaagcaccgacgcttcccagcgccggatgccagcaaaagtaaggaatatcaaggcccagagacagacaagcttccagcaggttgtccgctccgttgacctcgtattctttgccgtctacatgaattgtagccattagcatgcttccagttttctcagtcagagactgagcgttaatcgaaattcggttaccagcgctctttcagcaggttcggctgaatcccattaatcaaatgggtattgctgaacggctgtttgattcccgcctcaaattcttcgcggaaatatttgatggcgctctgtaacggctccactgcaccaggtgcgtgggcacagaaagttttacccgggcctaagaatcgacacagttgctcaagtgtttcgatatcgcccggctggccttcgccacgctccagcgcacgcagaattttcacgctccacggcagaccgtcgcggcatggcgtacaccagccgcaggactcacgggcgaaaaactcttccaggttacgcaccagcgacaccatgttgatctcgtggtcaaccgccatcgccagcgccgtacccagacggcttcccgctttaccgatactttcgaattccatcggcaggtcaaggtgcgcttcggtcaggaagtcagtccccgcgccgcctggctgccaggctttgaatttcagaccgtcacgcataccaccggcgtagtcttcgaggatctcgcgtgcggtggtgccgaacggcagttcccacagacccggatttttcacccgaccggagaagcccatcagcttggtgccagcatctttacttttcgagatgttctgataccactccacgccgttagcgaggatcgccggaacgttacacagggtttcgacgttgttaacgcaggttggtttaccccatgcaccggaggttgccgggaagggcggtttcgagcgtgggttagcgcgacgcccttccagggagttgattaacgctgtttcttcaccgcagatgtagcgccctgccccggtatggacgaacagttcgaaatcaaaacctgttcccataatgtttttgccaagcagacccgcttcggtggcttcggcaatggcacggcgtagattcactgccgcttcgatatattcgccgcgcaggaagatatagccacggtaagctttcagcgcaaacgcggagatgagcatgccttccaccagcaggtgcggcagttgctccatcagcagacggtctttataggtgcccggctccatttcatcggcgttacacagtaggtaacggatattcatggattcgtctttcggcatcaggctccacttcagaccagtcgaaaagcccgcaccgccgcgccctttcagaccagagtcttttacctgattaacgatttcgtccggagacaacccggtcagcgccttacgcgcgccttcgtaaccgtttttgctgcgatattcgtccagccacactggctgtttgtcatcgcgcagacgccaggtcagcggatgcgtttcgggagtacggataatgtttttcatttataccgctccagcagttcagggatcgcttccggggtcagatgcgcgtgagtgtcctcatcgatcatcatgtttggccctttatcacagttccccaggcagcaagttggcagcagcgtaaagcggccatcaaatgtcgtttgccctggtttgatgttcagttttttctccagcgccgcctgaataccctggtaaccgttgatatgacagaccacgctgtcgcaataacggatcacatggcggcctactggctgacggaagatctggctgtagaacgttgccacgccttcgacgtcgctcgccggaatacccagcacatcggcgatcgcgtggatcgcgccatccggcacccagccacgctgcttctgaacgattttcagcgcttcaatggacgccgcacgcgggtcttcgtagtggtgcatctcgtgctcaatcgcttcacgctctgccgcactcagctcaaaagcctcggtttgtggttgttgattctcgtgcataattagcggtccacatctgacataacaaaatcgatactgcccagataaacaatcaggtcagacaccaggctgccgcggatcgccgccggaatttgctgcaaatgcgcataactcggcgtacggatacgggtgcgataactcatggtgctgccgtcgctggtcaggtagtaactgttgatccccttggtcgcctcaaccatctggaaggattcattggcaggcatcaccggaccccacgacacttgcaggaagtgggtgatcagggtttcgatatgttgcagcgtgcgctctttcggcggcggcgtggtcagcgggtgatccgctttgaacgggccttccggcatgttgttgaggcactgctcaagaatacgcagactctggcgcaactcttctactttcagcattacgcgggtgtagcagtcagaaacaccaccacccaccgggatttcgaagtcgaagttttcatagccagaataaggacgcgccttacgcacgtcgaagtcgatcccggtggcacgcaggcccgcgccggtggtgccccactccagcgcctctttcgcgccgtaagcggcaacgccctgggaacgacctttcagaatggtgttttgcagcgccgctttctcgtaagacgccagacgtttcggcatccagtcgaggaactcacgcagcaggcgatcccagccgcgcggcaggtcgtgcgctacgccgccaatacggaaccacgccgggtgcatacggaaaccagtgattgcttccaccagatcgtaaattttctgacgatcggtaaaggcgaagaacactggcgtcatcgcgccgacgtcctgaataaaggtggagatatacagcaggtgactgttgatgcggaacagttcggagagcattacgcgaatgacgttaacgcgatccggcacggtgatcccagccagtttctctaccgccagcacataaggcatttcgttaacgcagccgccgaggtattcgatacggtcggtatacggaatgtagctgtgccaggactgacgttcgcccattttctcagcgccacggtggtggtaaccgatgtctggtacgcagtcgacaatctcttcgccatcaagctgcaaaacgatacggaaagcaccgtgcgcagacgggtggttcggaccgaggttgaggaacatgaagtcctcattttcggtgccgcgcttcatcccccactcttccggtttgaaggtcagggcttccatctccagatcctgtttggctttggtcagctcaaacggcgagaattcggtagcgcgcgccgggtaatctttacgcagcgggtgacctttccaggtttgcggcatcatgatgcggcgcaggttcgggtgaccgtcgaatgtaatgccaaatagatcccaggtttcacgctcataccagttagcgtttgggaataatttggtaaaggtcggtacgtgcaggtcgttttctgccagcgccaccttcagcatgatgtcgcggttacgatcgatagaaatcagatggtagaaaacggaaaaatccgcggcaggtaacccttcgcggtgtgtgcgcagacgttcgtccatgccgtgtaagtcaaacagcatgacgtaaggtttcggcagtttctttaagaaatcgcccacttccagtaattgttcacgcttgatccacacaacgggaaccccggtgcgagtcgcctgaacagtaaaggcatccggcccaaaacggttgcgcagttcgccaatcaccggatcatcaagatgatcgcgggtctgccaggcgggttcttgcgcggttaagtcggtcatattgttcaccattgcaaatggtccgtggtgactgtcggcgcagtaagcttcgcgaaatagatttaggaataagcgaagaaaattccctttgccgacaggcgcaaattaaatctcgtcaggtgtacgcaggttggttacggcaatgcgttcaccgcgcttgcgttcgcgctctgattgcatattggcgcgataaacgccctgatcgccaaccacccaggagagcggacgacgttctttaccgatagattcctgcaacagcatcagtgcctgcatgtacgcttcaggacgcggcgggcagcccgggatatacacatcaaccgggatgaatttatcgacgccctgcacaacggaataaatatcgtacataccgccggagttggcacaggcacccattgatataacccatttgggttccagcatctggtcatacagacgctgaataaccggtgccattttggtaaagcaggttcctgcaaccaccatcaggtcagcctgacgcggcgaagcacgcaatacttcagcgccaaaacgcgccacgtcatgtaccgcggtaaacgaagtcaccatctcaacgtaacagcaggaaagaccgaagttatacggccaaattgagtttttacgaccccagttaaccatgtcattgagcttgcccataaacacgtttttgttaacttcttgctccagagggtcggttacgatctcctgcttttgcagggggtaacggtcattctcaccgttgggatctatgcgggtgagcgtataatccatcttaatgcctcgcggttagcgttgacgattagcgatactgttcgtttccgggttcatacgctcgcggcgtgaacgcgcgggcgtccagtccagcgcgccaatacgcaccagataaaccagacctgccagtaacacaaaaataaaaattgcagcttccacaaagcctacccagccgctttcgcggatagaggttgaccatgcgaacagatacagcgcttcaacgtcgaagataacgaagaacatggccaccagataaaacttggcggacaggcgtaagcgggcggagccgaccgagtcgataccggattcaaacggaacgttttttgacctcgcgcgtgcgcgaccgcctaaaaaccaaccgcctaccagcatcaggcaacacaggccaatggcaacgataagaaagatagcgaatgcccagtgatgagcgatgacttcagtggatgttgacatactcattgcttactcatcaaaagtagcgcctgattctctgctctttacggcagatggacgccacatcgattcatggggaggaataaaaaaaaccttacaataactgcagaaactattttatacagctaattgatgtggtcttttactcctttctataaccttttgtcaactttaacaaaggtttcttcacactgatttacacaatgacaacaacatttgcatttggcgccctttctccccagatcattgacgactccaggaaaattagatgttgttgaatcgtgtccgttgtgaagcaatggaaaaaatacgggtctattttgacaggaatttgtgtcgattcctccccccaaaagagagtattttcttgatctgtgacacgcttttgtcattctataacaaaaatgcagcaacaaattcacgtattttttaacattattgtagcaggagatttttttcaggtgattatttgtgcgtacggggcgtgaatctctggtgattgaaaaatgaacagttttgtacgttctgcacgatacgaggaaggctttttactaaaaaaaagccgctggggtttaaaataaacccagcggttcgtttttacactattgtctcaggaattatctatcgtccgtcgattactcgatatccctttcaatcaacaatgagtcatctccttccggagcagacattgggctgtattgccacggattatggtagctctccatcgcctgatagatcacctgggccagctcattattactggacgggtcatagcacagcaaatattcggtatcaggtagcggcggtaagccatctactccactcagcacacgcaggtccggactcatcatctcgaccggccttgccgtcacgccaagaccggctttcactgccgcacgaacggccggaagcgtcgatgcgacataagccagtcgccagggaatatctgctttattaagcgtcgccagcaccatatcgcgaaacggacttggatcatccagcaacacaagagggatcggctcacctttttgcaatacgtattccgctgcgcagtaccagtgtgttggcgaggtacgcaggttcaatgccttaaaggtagaaggacgatgggtggttaccatcaaatccacttcctgggattccagcatttctgccatgtaggcattacgtttaacgcggacatccagcgctagtttcggataaaccgaactcacgcgatttaacaggaaaggtaagatcgtatcggcagattcatctgaagcaccgatagttaacacgccctgaagattactgaacattaatgatgagcaggcctcatcattaaaacgcaggattttcctggcgtaaccaagaagttgaatgccatgttcagttaacagtttgttgcgaccgtgacgagcgaacagttctttcccaacgagttgttccagacgctgcatttgctgacttacggcggactgagtacgacacacagcggcagctgcggcagcaaaagtgttcagatcggcaacagcaacaaatgttctcagcagatcgaggtcgaggttaattatcggacgatttgcacttatcatatattatcacttactggcggctcatactgagctggttaatgctgtgcacacacaaacaagcaattccatttgtaatgtgcctccctggcagtttcatccggaacccggacgaaagtaaaaatgcatatgagttgcactaaaaaagtgactcacattgttccgttataatgcctgaagtagatcacagaatatatcttcagggatcgcatatctattaagttactcactcttttctatttatgacatgcgcgtgtttgtataaatgtaaatgtgagtccttgttccactctcgtacagcatcgctggtcatacgcgaacacgtacaaacagcaatggtgaggcggcatcaagagcagggatccgtcatttatgcaagcattttaccccaaaaaccttttatttataagggtcattgcgaattatctgatgcaaagttatgttatgttaggcaaagtaatcttctattattaataagcacaacaaaacctttttgaatattaaataataattaattagcatcatccccattcattaattccgcttaacaatagtttcacgccttgcccccattgtgacacctcggaaatcatcacgctgttaaactctccgtaatgcggaaatatcatcatcgcgattcagtagtgaattcttaaacgaggcattttcacacaattatcttacagataaaaaaaccacacttacaattaagaatcagaataattcactacataacattacttattaagcatatgcacctcattattttgccattattaagttattaacagcacaatcgagccttcccctctggcaaaatcttattctgcagaccttcaaaacaccgtcctgggggagtacattgttctaagctgacttccacggcagggagtggcgataacagcaaaaaaggtcaagattcatgtcccccattgaaaaatccagcaaattagagaatgtctgttatgacatccgtggtccggtgctgaaagaagcaaaacgcctggaagaagaaggtaacaaggtactgaaactgaacatcggcaaccctgccccgttcggttttgacgcgccagatgaaattctcgttgacgtgatacgcaacctgcctaccgctcaagggtattgcgattccaaaggtctttactccgcgcgtaaagccatcatgcagcactaccaggctcgtggcatgcgtgatgttaccgtggaagatatttacatcggcaatggtgtatcggagcttatcgttcaggcaatgcaggcattgctgaacagcggggacgaaatgttggttcctgcacctgattacccactatggaccgcagcggtttcgctctccagcggtaaagcggtgcattatctttgcgatgaatcctctgactggttcccggacctcgatgatattcgcgctaaaattacgcctcgtacgcgtgggatcgttattatcaacccaaataacccaaccggcgcggtatattccaaagagcttttaatggagattgtggagattgcacgtcagcataatctcattatcttcgccgatgaaatttatgacaaaattctctacgacgacgctgagcatcactccattgcgccgctggcacctgacctgctgaccattacctttaacggactgtcgaaaacgtaccgcgttgcaggcttccgtcaggggtggatggtgttgaacgggccgaaaaaacacgccaaaggttacatcgaaggtctggaaatgctggcttcaatgcgcctgtgtgctaacgttcctgcgcaacacgccattcagaccgcactgggtggttatcagagcatcagtgaatttattacccctggcggtcgtctttatgagcagcgtaaccgcgcgtgggaattgatcaacgatattccgggcgtttcctgcgtgaaacctcgtggtgcgctgtatatgttcccgaaaatcgacgccaaacgctttaacattcacgacgatcagaaaatggtgctggatttcctgttgcaggaaaaagtcctgttggtgcaagggacggcattcaactggccgtggccggatcacttccgcattgtcacgctaccgcgtgtcgatgatatcgagcagtctttgagcaagttcgcgcgtttcctttctggttatcatcagctgtaatcttaatttcactgccggagattgcatccggcagtgttatcccgccacaatgacctgatgatgtcatcatacgtaaggtcactatgaaacagagccatttttttgcccatctctcccgcctgaaactcattaaccgctggccgctaatgcgcaacgtgcggacggaaaatgtgtccgaacacagtttgcaggtagcgatggtcgcccatgcgctggcagctatcaaaaatcgtaaatttggcggtaatgtcaacgccgaacgtatcgctttactggcgatgtaccacgatgcttcagaagtgctcaccggagatctccctactccggtgaaatacttcaattcgcaaatcgctcaggaatacaaggctattgaaaaaatcgctcagcaaaaactggtcgatatggttccggaagagctgcaggatatctttgcgccgttaattgacgagcatgcatatagcgatgaagaaaaatcgctggtgaaacaggcagatgcactgtgtgcatatctgaaatgcctggaagaacttgcggccggaaataatgaattcttgctggcaaaaacgcgactggaagcgacgcttgaagcgcgccgcagccaggagatggactacttcatggaagtatttgttcccagcttccatctttcgctcgatgagattagccaggattcaccgctgtaagcagccggagtctgcgtcgcatcaggcaataagcaccggatgcgacatcaggctcttgtcaaaacggaaacagcatcgggatcatcaccacacaaaccgccatcacgataatggtgaacggtacccccaacttaacaaagtcactgaagctgtaattccccggacctaaaaccagtgtgttaacaggtgaagatatcggtgtcataaaggcggcggatgctgccatcgccacgaccatcgcaaatggataaggcgacacacccatcgttttggcagcagccagcgcaatcggagccatcaacaccgccgtcgcggtattagagataaatagcccaataaccgccgacaagacaaacaaacaacccagcatcatatgtggcccgtaaccgccgccaatgtccatcagccctttcaccgccagcgcgacacctcccgttttctgtaatgccacagcaaatggcatcatcccaacgatcaaaataatgctcggccagtgaatggatttataggcgctttcagcatctatacagcggaatttccccatcagcaggcaggcgataatagcggcaacaggattaggaatttcatcggtcagcattaacgccaccattagcaccagacagaaaatcgcatggggtgcctggctgtgcgcgggcgatgcttcactcacctcttccggtaagttcagcgctacgaagtcgcggccctgtttggccagcataccgatcagtttccagttacccacaaccaggatgatatcgcccagcagcagaggctcatccgccagcgaaccttccagcgccacgccattgcgctttagccccactacattcaatccgtagcgggtacgaaaaccaatttcgcgcaccgatttaccaataagttctgactcaggaattaatgaaatctctgccatgcccacatcaagggcctggtcagaaaaatactcgccgcgcagtaccatcggctccagcaattgctcactacaaaattgccggagatcaacatcagccgcagacatatcaataagcaaaacgtcacgcgcgcgaaattcagaaaccccattaacgttcacgataacgcgacgaaaacgccgccagcgttcaacaccgatgacgttagcaccataacgttcacgtaatttgagatcgtccagccgttgaccaatcattggcgatccggggcgaatagccagacgtcgcgcacgcccggtcagtcgatattcacggataagatcgcgaaaggttcggcgcgtccagccttcgcgttgtggggtctgggtatcccctttcagcatgaaacgcatcactaacatatacaaaatacccagcaccagcacgaccaggccaataggtgttacgctaaagaaactgaagccgtgatagccttcacgcagcaattcactgttgactaccaggttcggcggcgtcgccaccagcgtcatcatgccgcttatcagcccggcaaaacttaacggcatcatcagacgcgacggcgacgtttgcatacgcatggcaacgcttaacaccacgggaataaagatagcgacaacgccggttgaactcataaacgcgccaagccccgcgacggtcagcatcaacaaaaccaacattttgatttcactgttgcccgccactttgaccagccatgtccccattacagtggcaacaccggtacggaccaaaccatcgccaataatgaacaaggcggcaatcaggacaacgttaggatcggaaaagccggaaaatacttcggggaccgtcagcgttccgcttaatgcaaacgcgacaataacaaacaaagcgaccgcatccatacgcactctgcccgtcgcaaacaagacgatggcaacggccagtaatgaaagaacccaaatcaattcaccgttcacaacttatccttgttaattgagggggataacttgattctgccataaaaaagccccgacgagacggggctaaatcatgatcaggtgtttcactgaataataacatcgccatttggctgtttggtcacagtaatttgctccagactgtggaggactaaatcgacttcattcaggcgcggggtatctgccggggcattaaccgcaataacatggcaacccgccgccagacctgaaagcacgccagcgggagcatcttccaccacaacacactcctgcggcgcaagccccagcagctgcgcgcctaacagatacgcatcaggttctggttttccgcgcttcacccgctcagcggttacaaacacctctggcgcgggaagccccgctattttatgacgcgctcgcgctaccggcatggagccagaagtcacaatagcccacggaatacctgctttattcaaatgattgagtaaggcgattgcccccggaagcgcggtaatgccttcggtttccgtggcctcgatgtgctccagacgcgtaaactcggcggcaatgtctgcctcggatttgcccgccataaaatggcgcagagaggtgatcgcctgtttaccgtgaatgaaagccagcacctcttccggcgataacccatgacgtctggcccagttgctccacgcccgttctaccgcaggcagggaatccaccagcgttccatcaagatcaaacagaaaacctttgcaccgcacgcgggcctcctcaggcgttaataatttgattaatttcgttggcgctcaaatggtactgacgcgggcaggcatgccagacattaagcatgcgctgatatttttcccacattggcgtctgggcgttaaaaccgtgagttccagcgtcaaaatgggtatagcgcccttccacattaaccataaagcggacataaccgaggtaacgtgcttcagtggcagcgtcaaagccgaggaaggtgacacgacgttcatcgatggattgctggtcctgcaaattagaccaggaaacatgcaacgcatgatacatctccataatgtcgatgatagtgcggcaggtttcttctttcagctcgccaaactcgcgatccagttcacgcatctgtaatccataaccacgctcaatgattgtttgcaggcgacggtaacgttcagcatttgccggatcgagcatagtcatcatcttgtactggttagacaaaataagacgttgcgcgttggtcatttccattattgactcctgtatcactctactacggtgaaaaaaaagaaggctgagtatgccttcttttatatgcgtaatcaggggtcaattacaaatcatcaaggaaagttttatccagttgtttgaaggcacgcttaagcgtgtcagctaatgcctggtaatcaggcttgccttcaacgggtgccaacacctgtccagactcctgcaatttaccgcgaacttcataaaaccagttgaggattgcaggaggtaatggcgttacagaacgcttgcccagccaccacaatccctgcatgggtaaacttaaggcgaacagcgcagtggcaactgccggcccaagctgaccgcccagggcaatctgccagcagagagtaaatacggcgatcggcggcataaaacggatcgcataacgcgtcatcttgataacgcgattttcgacaaagactggggcaaggcgtttttccagcggccacgtctttgagtaatgctgtccccggcgaaacaagctaaaaaaattaacagaacgattatccggcgttgacatgcttcacctcaacttcacatataaagattcaaaaatttgtgcaaattcacaactcagcgggacaacgttcaaaacattttgtcttccatacccactatcaggtatcctttagcagcctgaaggcctaagtagtacatattcattgagtcgtcaaattcatatacattatgccattggctgaaaattacgcaaaatggcatagactcaagatatttcttccatcatgcaaaaaaaatttgcagtgcatgatgttaatcataaatgtcggtgtcatcatgcgctacgctctatggctccctgacgtttttttagccacgtatcaattataggtacttccatgtcgagtaagttagtactggttctgaactgcggtagttcttcactgaaatttgccatcatcgatgcagtaaatggtgaagagtacctttctggtttagccgaatgtttccacctgcccgaagcacgtatcaaatggaaaatggacggcaataaacaggaagcggctttaggtgcaggcgccgctcacagcgaagcgctcaactttatcgttaatactattctggcacaaaaaccagaactgtctgcgcagctgactgctatcggtcaccgtatcgtacacggcggcgaaaagtataccagctccgtagtgatcgatgagtctgttattcagggtatcaaagatgcagcttcttttgcaccgctgcacaacccggctcacctgatcggtatcgaagaagctctgaaatctttcccacagctgaaagacaaaaacgttgctgtatttgacaccgcgttccaccagactatgccggaagagtcttacctctacgccctgccgtacaacctgtacaaagagcacggcatccgtcgttacggcgcgcacggcaccagccacttctatgtaacccaggaagcggcaaaaatgctgaacaaaccggtagaagaactgaacatcatcacctgccacctgggcaacggtggttccgtttctgctatccgcaacggtaaatgcgttgacacctctatgggcctgaccccgctggaaggtctggtcatgggtacccgttctggtgatatcgatccggcgatcatcttccacctgcacgacaccctgggcatgagcgttgacgcaatcaacaaactgctaaccaaagagtctggcctgctgggtctgaccgaagtgaccagcgactgccgctatgttgaagacaactacgcgacgaaagaagacgcgaagcgcgcaatggacgtttactgccaccgcctggccaaatacatcggtgcctacactgcgctgatggatggtcgtctggacgctgttgtattcaccggtggtatcggtgaaaatgccgcgatggttcgtgaactgtctctgggcaaactgggcgtgctgggctttgaagttgatcatgaacgcaacctggctgcacgtttcggcaaatctggtttcatcaacaaagaaggtacccgtcctgcggtggttatcccaaccaacgaagaactggttatcgcgcaagacgcgagccgcctgactgcctgatttcacaccgccagctcagctggcggtgctgttttgtaacccgccaaatcggcggtaacgaaagaggataaaccgtgtcccgtattattatgctgatccctaccggaaccagcgtcggtctgaccagcgtcagccttggcgtgatccgtgcaatggaacgcaaaggcgttcgtctgagcgttttcaaacctatcgctcagccgcgtaccggtggcgatgcgcccgatcagactacgactatcgtgcgtgcgaactcttccaccacgacggccgctgaaccgctgaaaatgagctacgttgaaggtctgctttccagcaatcagaaagatgtgctgatggaagagatcatcgcgaactaccacgctaacaccaaagacgctgaagtcgttctggtggaaggtctggtcccgacacgtaagcaccagtttgcccagtctctgaactacgaaatcgccaaaacgctgaacgcagaaatcgtcttcgttatgtctcagggcactgatactccggaacagttgaaagagcgtatcgaactgactcgcaacagcttcggcggtgcaaaaaacaccaatattaccggcgttatcgttaacaaactgaacgctccggttgatgagcagggtcgtacccgtccggatctgtccgagatttttgacgactccaccaaagcaaaagtgaacaacgttgatccggcgaagctgcaagaatccagcccgctgccggttctcggcgctgtgccgtggagctttgacctgatcgcgactcgtgcgatcgatatggctcgccacctgaatgcgaccatcatcaacgaaggcgacatcaatactcgccgcgttaaatccgtcactttctgcgcacgcagcattccgcacatgctggagcacttccgtgccggttctctgctggtgacttccgcagaccgccctgacgtgctggttgccgcttgcctggctgccatgaacggcgtagaaatcggtgcccttctgctgactggcggctacgaaatggacgcgcgcatttctaaactgtgcgaacgtgctttcgctactggcctgccggtatttatggtgaacaccaacacctggcagacttctctgagcctgcagagcttcaacctggaagttccggttgacgatcacgagcgtatcgagaaagttcaggaatacgttgctaactacatcaacgctgactggatcgattctctgactgccacttctgagcgcagccgtcgtctgtctccgccagcgttccgttatcagctgactgaacttgcgcgcaaagcgggcaaacgtatcgttctgccggaaggtgacgaaccgcgtaccgttaaagcagccgctatctgtgctgaacgtggtatcgcaacttgcgtactgctgggtaatccagcagagatcaaccgtgttgcagcctctcagggtgtagaactgggtgcaggcattgaaatcgttgatccagaagtggttcgcgaaaactatgttggtcgtctggtcgaactgcgtaagaacaaaggcatgaccgaaaccgttgcccgcgaacagctggaagacaacgtggttctcggtacgctgatgctggaacaagatgaagttgatggtctggtttccggtgctgttcacaccaccgcaaacaccatccgtccgccgctgcagctgatcaaaactgcaccgggcagctccctggtatcttccgtgttcttcatgctgttgccggaacaggtttacgtttacggtgactgtgcgatcaacccggatccgaccgcagaacagctggcagaaatcgcgattcagtccgctgattccgctgcggccttcggtatcgaaccgcgcgttgctatgctctcctactccaccggtacttctggtgctggtagcgacgtagaaaaagttcgcgaagcaactcgtctggcgcaggaaaaacgccctgatctgatgatcgacggtccactgcagtacgacgctgcggtaatggctgacgttgcgaaatccaaagcaccgaactctccggttgcaggtcgcgctaccgtgttcatcttcccggatctgaacaccggtaacactacctacaaagcggtacagcgttctgctgacctgatctctatcggaccgatgctgcagggtatgcgcaagccggttaacgacctgtcccgtggcgcactggttgatgatatcgtctacaccatcgcgctgactgcgattcagtctgcacagcagcagtaatctcgtcatcatccgcagctttgcgctgcggatatctgaaccggaaatagtcactatttccggttttttattctcttaatttgcattaatcctttctgattatcttgcttaactgcgctgcatcaatgaattgcgccatctcactttgcatacttaccactttgttttgtgcaagggaatatttgcgctatgtccgcaatcactgaatctaaaccaacaagaagatgggcaatgcccgatacgttggtgattatcttttttgttgccattttaaccagccttgccacctgggtagttccggtgggcatgtttgacagtcaggaagtgcagtatcaggttgatggtcaaacaaaaacacgcaaagtcgtagatccacactcatttcgcattctgactaacgaagcaggcgaacctgagtatcaccgcgtacagctgttcacgacgggcgatgaacgcccgggtctgatgaacttcccgtttgaagggttaacctcaggatcgaaatacgggacagccgttggcatcatcatgtttatgctggtgattggcggcgcgtttggcattgtgatgcgtacaggaaccattgataacggtatcctggcgcttattcgccatacccgcggaaatgaaattctctttattcccgcgctgtttattctgttttcacttggcggcgcaatatttggtatgggagaagaggccgtcgcctttgccattatcatcgcaccgctaatggtccggctgggctatgacagtattaccaccgtccttgtgacctatattgccacgcaaatcggttttgccagttcgtggatgaacccgttttgtgtggttgttgctcagggtattgccggcgttccggtgctttctggctccgggttgcgcatcgtggtgtgggttatcgccactctgattggcctgatctttaccatggtgtacgcctcacgagtgaaaaagaatcctcttctgtcacgcgtgcatgagtccgaccgcttctttcgtgaaaagcaggctgatgttgaacaacgtccgtttacctttggtgactggctggtattgattgtcctgaccgccgtaatgatctgggttatttggggcgtgatcgttaatgcctggtttattcctgaaattgccagccagttcttcaccatgggtctggtgattggcatcatcggcgttgttttccgccttaacggcatgacggttaataccatggcttcatcctttaccgaaggggcgcgaatgatgatcgcccctgccctgctggtgggtttcgccaaagggattttgctgctggtcggtaatggtgaagcgggtgatgccagcgtgttaaataccatcctcaacagcattgccaatgccattagcggtctggataacgcagtcgcggcctggtttatgttgatcttccaggcggtatttaatttcttcgtgacgtccggttctggtcaggcggcgttaaccatgccgttactggcaccgcttggcgatctggtcggtgttaaccgtcaggttaccgtgctggctttccagtttggcgatggcttcagccacatcatttacccaacctcagcttcgttaatggcaacgctcggtgtttgccgggtggacttccgtaactggctgaaggtgggtgcgaccctgcttggactgctgtttattatgtccagcgtcgtggtgatcggcgctcagttgatgggctaccactaaaaatgttaagagccgcaattgcggctctttttttcattctgccgtttcagtctctacggcttcatttttggcattgcgcttcatccacaacgccagcgctttcagcgagtctggagtgaactcatcgcagcgtgcggtgatttcttccggcgtcagccagcaaacttcactgacttcatcttcctgtagagcgaagggaccgtgagagacgcagctgaacaacgcgccccagacacggcaatttttatcttcgaaatagaactgcccgtgctcggcaaaggggaccccggcaatgcccaactcttcttccgcttcgcgacgcgcggattccagcagttgctcatcggcctggactacaccgcctgcggtcgcatctaacatgccgggtaaaaagtcttttgtctcggtacgacgctggaccagaattttgcccatgccatcatgcacgacgatataagttgcacgatgacgcagacactgtgcccgcatttgttcccggctggcttgtgcaatgacttcgttctcttcattgacaatatccacccattcagtacttgccaaacgacgctgttccattatcaggaaaccttctttttctggcgctcttacggcgcattttgagttgtgggtaaattacggattaatcgcgacctgcgcaatgatactttgatcattgagtgcgattacactaagtacgtcattatccagcatgccataactcgccggattaccgcctttcggaatactcaccgagccggggttgaagtggaaaatctccccccgctgttctgccactggcagatgggtatgaccgtacaccagcacatcgttctggtttaaagcaggtagattttccgggccaaaaagatgaccatgcgtcaaaaacagtcgttgtttttccagtaatacctgttgccacggcgcggttatcgggaaatgcagcagcatttgatccacttcgctgtcgcagttgccgcgcacagcgataaccttatgtgccacttcattaagccgttcagcgactttggctggcgcgtaaccctccggtaaagcattacgcgggccatgattcaacacgtcgccaaggatcaccagccactgggcaccgctttggacaaacaactccagaacacgttccgtcgccggtaacgacccatgaatgtccgatgcaaacatcagtttcatcactcactcctcgtcgaaaaaacgtaagctatgatactggattctgtcgttgctatcagccagattgcttcgccgaaagtgcaataaaacgctggacagacgctcgctgccactggaatgtcgcataatccaccaggcgttccggcacctcatcgccatgtagtaccaggcggttaatcattagcgccagatcagtatcagcaatgcaccattcaccaaataaattcggctgacccagtgctaacaaatgctctgccatcgcgaacaatttctctgcactggcttttccctcggccgttagtggcgcttttttcgcccccgcaaagacaacatccgtcgggcgttcttcgcgaatgggcatcagatcgctgcgcaaccaagcctgaatctgtcgtgcacgcgcacgattttctaaatcaagcggataaatacgttcccaggtcggtggcgcaaatcgatcttccagatactccgcaatggcagaagattcactcaactcaaaatcatcgatttgtaataacggcacacggcgtgtctgaccgtaaccttgccacgccggctgcaaatgttcaccgctgtcgaggtcgatggtcttgatatgaaacgacaggcctttctcctgcaacgccacccaggcggataacacataaggggagaaaaaatgggcatctgaccaaagcgtgatagcggttttactcattatgtcctcggcaataaagggggcttgctatcaaactatagagcctttttgtcactgtcacgtgacgaatactcacgcaagtcgccgcgctttctatacttgtggtgttcagatgattagacaaccggagctgcaatgatcgatctctatttcgccccgacacccaatggtcacaaaattacgctgtttctcgaagaagcagggctggattatcgcttaataaaggtagacctggggaaaggaggtcagtttcgcccggaatttttgcgcatttcgcctaacaacaaaattccggcaattgttgatcattctccagccgatggcggcgaaccgctaagcctctttgagtctggtgccattttgttgtatctggctgagaaaacgggactctttttgagtcatgaaacgcgtgaacgcgccgtcacattacagtggttattctggcaggtaggcggactggggccgatgcttgggcaaaatcatcattttaatcacgcagccccccaaaccattccttacgctattgaacgttatcaggttgaaactcagcgtctgtaccatgtactgaacaagcggctggaaaattcgccctggctgggaggcgagaactacagcattgcggatattgcctgctggccgtgggttaatgcctggactcgccagcgaattgacctcgcaatgtatccggcagtcaagaactggcatgagcggatccgttcgcgccctgccaccgggcaggcactgctaaaagcacaacacggtgatgagcgttcggatagttaacagaaacaggttctcgtgtattatttcatcctaagtaaaacaacggagaacctgcaatggcacaacctgccgctattattcgtataaagaaccttcgtttacgtacgtttatcggaattaaggaagaagaaattaacaaccgtcaggatattgttatcaatgtgacgatccactaccccgccgataaagcgcgcactagcgaagatatcaacgatgcgctgaattatcgcaccgtaacgaaaaacattattcagcatgtagagaataaccgtttctctttgctggaaaaattaactcaggatgtgctcgatatcgcacgtgaacatcactgggtgacgtatgctgaagtggagatcgataaactgcacgcgctgcgctacgccgattcggtatccatgaccttaagctggcagcgttaaccgccatattgggaggctgcatgaacatagtgatcaccggagggacgggattaattggtcgccatttgattccacgtttgctggacctgggccatcaaatcacggtagtgacgcgtaacccgcagaaagccagttccgttctcggccctcgggtgacactatggcaagggcttgccgaacaaagcaacctcaacggcgttgatgcggtaatcaacctggccggagaaccgattgctgataaacgctggactcacgagcaaaaagagcgtctctgccaaagccgctggaatatcacgcaaaaactggtcgatttgattaatgccagcgacacgccaccgtcggtactcatttccggctcggcaacgggctattatggcgacttaggtgaagtggtggttaccgaagaggaaccgccgcataacgaatttacccataaactctgcgcccgctgggaagaaattgcctgccgggcacaaagtgacaaaacgcgagtgtgcctgctgcgtaccggcgtagtgctggcaccggatggcggtattctcggtaaaatgctgccgccgtttcgtcttggcctgggcgggccgattggctctggtcggcagtatctggcctggattcatattgatgatatggtcaacggtattctctggctgctggataaagagctgcgcgggccatttaatatggtttcgccctacccggtgcgcaatgaacaatttgcccatacactgggtcatgcgctgcatcgcccggccattttgcgcgtccctgcgaccgccattcggctgttaatgagcgaatcttcagttctggtattaggcggtcaacgcgcgctgccaaaaaagctggaagaagcgggttttgcgtttcgctggtacgatttagaagaggcactggcggatgtcgttcgctgatgtggtttactgcaaacatccgccagttaactcccggtgttacagggttagtggctttgcgcgataagatcgtctggtgaaagtcgggtcagcgtcaggatgacttcgtggtcaaatcctttttccatcatctcctgagcaatgcgcagggcttcttcgtgtttgccctgcattgcgccttcttcacgtaatctgtcagcaatggtcatcagtttctccttttcttgtggtgcgcgttccgctatctcaccaataaatgcacggaaacgccgggcatcccccgtttgtaatacgtaattaaacagggcttttagctgtctgtcattagtgttccctgtaactagcagcgaaacaatttggtcgactaatcccaacagatcgcgctgacgaatatgtttctgaattaactccaacagcgccattttgcgatgttgcataatctcgtcatccggcaccacggtaatatccaccagcggaaaagccgatgaataaattttgcgggcaatcgcaggctcggcaaattcatcaagccagcagagtgaatatggataagggcttctgcaaccatgataaaacagcatcgggatcactaatggaagctctttataacccgcatcaagatggttttgcatcgccgcaatggaatagcgcatcatgcgaaaagccattaattcctctggcttactttggtgctctatcaccacataaatataacccgctccctcctgcgttttcacagaccacaagaggtcggaataatattgccgcaggtcttcatcaataaaactgtttggttccagtttaagcgtcgttaaatcacacagtttgcgcagcggcgcgggaagatgaatatcaataaaatcccgcgcggtgtctggatggcgtaaaaaagatttaaataccgcatcatgcggcgtggaagttgtcgatattgtcatggcgttccgtcacccctcaaatttaagatgacgcgacaataaccacgatttacacccaatgcagcaggcagtttttatctttggacagcgaattcagaactatttttagcggactgcaacttttacatttcagcggaagcggactcgcaaattccccatgaaatactccggcagcgttaaccaccggagaggaaattatttcagcgaacctttaaggaactgttgcagacgagggctttgcgggttaccgaataactgctccggcgccccttcttcttctattttcccctgatggaggaaaatgacgtgagtagaaacatgacgagcaaagcccatttcgtgagtcactaccaccatggttttcccctcttctgccagttgctgcataatacgcaacacttcgcctaccagttcaggatcgagcgctgaagtaggttcatcaaacagtaaaacttccggttccatcgctagcgcccgcgcgatagaaacacgctgttgctgaccaccggacaggtgtaccgggtatttcccctgcgcacgttcgtctatcccgacttttgccagatatttcaccgcccgctcgcgcgcttcctgcttgctcaggcccaacacctgaatcggcgcttccatgacgttttccagcaccgtcatatggctccagagattgaagtgctggaataccatcgtcaggcgtgtgcgcaataagcgcagctgatttttatcggcgactttgagttgaccgtctttatcgcgcaccagattgatcgtctggccattgaccacgatcgatccttcgctcggtttttcgaggaagttaatgcagcgcagaaaggtacttttacccgatcccgacgatccgatgatgcttatgacatctccggcattcgcttgcaatgagacccctttcagcacttcgtgttcgccgtagcgtttgtgcaaatcgataacgtttaatttattctcggacatcgtattctcagtgcgttgaagaaggtttcacatgctgcaaccagcgtttttcagctctacgaaagaggctgatcaggacataagagatgattaaatagagcaccgcggcaatgccgaaagcggtaaaaggttgatatgtggcggcgttaatatcgcgggcaattttcagcagatccggcaccgtggcagtaaatgccagcgcagtagagtgcagcatcaggatcacttcgttgctgtacgccggtaacgcaatacgcagcgcagaaggcaaaataatgcagcgatacattttaaaggtcgagaagccataggctctggcggcttcaatttccccatgcggcactgaacggattgccccggcaaaaatctcggtagtgtaagcgcaggtgttaagcgtcagcgccagcacggtacagttcagaccactgcgaaaaaaggcgttaaggaactcggttcccttaacaatctccagcgtgtacatgccggaatagaacaccagcaactgaacatacagcggcgtaccgcgaaaaatataggtaaataaccagattggaaactggatgtatttattacttgagacgcgaccaatcgccagaaacagcgccagaactccgcctatcactaccgacaaaatcagcagccacagggtgatcgccacgccagtaaagcgataaccgtcagtccacagcagtggtttccagtattcatgtaagatttcgatcacaggtcagccctcttcacacccacggagtagcggcgctcaaggaacagcagcacaccattggaaacggtggtgaaaacaagataaatcacgccacagacgatagcgaaatagaacggttcccaggtacttttgcctgccagttgcgtggctttgaccacatcttccaggccgagtaacgaaaccagtgcggtagatttgaggatcacctgccagttgttgccaatgcctggcagggcgtaacgcatcatcgccggaaacatgatccgccgaaacacttgcccacgagtaaaaccgaacgccgtcgccgcctctatatgtcctttcggcactgccataaacgctccacgaaacgtttcggtaaaataagcaccgtagataaaaccgagagtgataatacctgcgaccatcggatcaatatcaatctgcccgacgcccatcgcctccgtcaccgtgtttagcgcaatctgcaaaccgtagaaaatcagcagcatcaatactaaatccggcacgcctcgaatcagcgtggtgtacccttcgaaaataaggcccgaaagccgattttgtgagagcttaccgccagcgccaattaaaccgatgattacagcgagcactacagagctgatagccagctccagcgtgacgagcgcaccctgtaaaataacacctgaaaacccatacaacatgctgcctgtcctgtcgtgtgtggtgaattaccgcctcttgtctccctccggatacccgaagggagcgggctttctttcaccgatggcgattaaccaccataaacatcaaaatcgaagtactttttcgctaatttctcgtaagtaccgtcagcgcgcatttcggcaaaggctttgttcagtgcctcgcgcagttcgttatcttctttacgcaggcccatgccggtccctacgccaaacagtttttcatctttaacagacgggccaccgaatttgtaatctttaccgacgggttgtttgaggaaaccttcgctggctgcgacctcatcctggaacgcggcatcaatacgtccggcagtcaggtcagaataaatattgtcctgcccctgataagaaacgatttcaatgccttttggtgcccagtgttcgttaccgaacgtctcctgggtggtgccctgcaatacgcctacccgtttgcctttcagcgattcgactgtcggctgaatgtcggaatttttcgccaccaccagacgagaatcggcagcgtacagtttgtcggtgaaggctatttcttgctgacgtttttccgtaatggaaagcgatgacatgatggcgtcaatcttcttcgcttttaaggacgggattaacgcatccagtgggttttcgacaaacgtacattgcgtattgatgcgtttgcacaactccttcgccagatcgatatcgaagccaaccagttcaccttgtgaattttttgattcaaatggcgcataggtcggatcggtaccgatgcggatgttttgcggaatcgcagcaaatgccgcagttgcgctggagaaggccagaaccagagagagcgatagcaccagttttttcataatgtcctcaactgacagtctttttatcgggaatatttacaggtttgttacacttatcgtgccataaaattgaccatcaaggcaaaatatcccgccccgctagacgtattatttttcattaaaaatgcttaagtatgcatttcaatgcaccacgatagtgcaacaaacctggcgtgcaccatgatgatcattccatcaggtacagcttccctgcgacgtatcagtcaccgtagacattaaagtcgaaatactttttcgccatcttgtcgtaggtaccgtcctgacgcagctcgccaagcgccttattaaacgcagccgtcagttcagcatcatctttacgcagccctacaccggtgccgtcaccgaagtattttttgtctttcactgatgggcctgcaaaggcgaaatctttaccggcgggttgcttaaggaaaccttcgctggcagcaacttcatcttgtaacgcagcatccagacgtcctgcagccagatcggaatagactaaatcctggttggcataggccaccacatccacgcctttgctacgccaggtctcgttagcgtatgcttcctgggttgatccctgcagcacaccaacatgtttacctttcagtgaatccagcgttggctgaatcggtgaacctttggcggcaatcaaacgagaatctgcggcgtacaacttgtcggagaaagcaatctcctgctgacgtttatcggtaatggagagcgacgaaataatggcgtcgatttttttcgctttcagtgaggggatcagcgcgtcaaagtcgctggcaacccaggtacatttcacctgcatccgtttgcacatctcgttaccgagatcgatatcaaagccaacaaaatcacctttagcatctttcgacgagaacggcgcataggtggtatcggttccgatacgtaccgtctccggtagcgccgcatagctggaagccgctgcggagagaccgactaacaaagacagagcgagaatcgacttcttcatacataaccctcaagtgaaaatggcttttttatgttgtgtattgtgttgtgtgtttgcaggctctttcatgcaggtcttatgccatcttgacgacagcagtaacattcaacgttaaatatgttaataagacgttgcattattgtcctgaagttgaagatagcaggtatagcggttgaatcgcagcgtttcgattgaatggcagaaacaaaatgtcgaggatttgatcgcggttgcaaaattgccctgaaacagggcaacagcggagttatgcgccctgccagcgggcaaagagatcttcaggaagggttaccgcaaactggtcaagaacacgattaaccgtctgatttatcacatcatcaagggattgtgggcgatgataaaacgccggaacgggaggcataatcaccgcaccgatttctgccgcctgagtcattaaacgcagatggcctaagtgcagtggcgtttcacgcacgcagagcaccaacgggcgacgttctttcagcaccacatctgccgcacgggtcagtaagccatcagtatagctatggacaatgccggacagggttttgattgaacagggtaaaatcaccatccccaacgtctggaaagaaccggaagaaatgctggcagcaatatcgcgcgcatcgtgtgtcacatcagctaacgcctgcacttcgcgcagggaaaaatccgtttcgagggataaggtctggcgcgccgcctggctcattaccagatgcgtttcgatatctgtgacatcgcgcagaacctgtaataaacgcacgccataaatcgcgccgctggcaccgctgatgcctacaatgagtcgtttcataaatagttgccctgtcagacttgcaggcagactttgcaggatttcggcgggagttgcaagtcagggtgccagaccggcaccctgagtgaaggcatcatccttcgttatgcatttcgagattttccacttcgttctgacgttgcactgctttggcgtcgtcattacgtaaagtatcaaggaaatcgaggtagccctgatcaacgtctttggtgacgtagacgccgttgaacaccgagcattcaaactgctggatatccgggttttcagcgcgaacggcttcgatcagatcgttcagatcctggaaaatcaacccgtcagcaccgatgatctggcgaatttcatctacttcgcgaccgtgagcgatcagttccgtggcgctcggcatatcgataccgtaaacgttcgggaagcgaatttccggtgccgcagaagcgaggtacactttcttcgctccggcttcgcgtgccatctcgataatctgctcagaagtggtgccacggacgatagagtcgtcgaccagcaggacgtttttatcgcggaactcggcgcggttggcgttcagtttacggcgcacggacttacgacgcagctgctgacccggcatgatgaaggtgcggccaacataacggtttttaacgaagccctggcggtacggtttgcccagaatacgcgcaatttccagcgcgatatcacacgaggtttccggaatagggatcaccacgtcgatatccagatcttcccattcgcgggcaattttctcgcccagtttggtgcccatattcacgcgcgcgctgtaaacggaaattttgtcgatgaacgagtccgggcgggcaaagtatacatactcaaacaggcacggattgctgaccggattgtcagcacattgacgggtaaataactgcccttcttcagtgatgtaaatcgcttcgcctggcgcgacgtcacgcaggaaatcaaagcccagcgtatcgagcgcaacgctttcggaagcgaccatatattctgtgcggttctcgtcaatatcacgttttcccagtaccagcggacgaatcccgttaggatcgcggaaagcaaccataccgtggccgatgatcatcgccacacaggcatacgcgccgcggattaagcggtttgtagcagcgatggcggcgaaaatgttgtcggcttccagcgggtagtggcggaagttgtccagctcgctggcgaagatattaagcagaatttccgagtcggaagtggtgttgatgtggcggcgtttttcttcaaacagttttttacgcaactcgtgagcgttggtcagattgccgttgtgggcaagcgtaatgccatacggggagttaacgtaaaacggctgcgcttcagaggcgctggagctgccagccgtggggtaacgcacatgaccaatgcccatattgccctgcaaacgctgcatatggcgagcttcaaatacatcgctcaccagcccgttcgctttacgcaaacggaagcagttattggcatctatggtgatgatgccggcggcatcctgaccgcgatgctgaagcaccgttaaggcatcataaatcgactggttaaccggcataacaccggcgataccgacaataccgcacatacgtctttttcctcgttaagccacatctcagagcacttacgctctgggcaagaaacttgacgagctttgcagataatcaaaaaaccatctgatgataaaactgaactgcgggatcagctgtgatttgctccagtcttcgcttttcgacaccccggtaaaggagtcgagaaagaagagaatggcagcaacaatcaacacaccgcgcaacgcaccgaaacagacgcccaacacccgatcggtgcctgacaaccccgttttctccaccaactggcctatcacgaagttcacgatagcaccaacgatcagggtagcgataaacagtaccgcgatggcaatcccatttcgaaccagttcgtcttcaaagcccgtaaaccagactgacaggtaagtgtagtaatgactggcaacaaagaaagcacaaccccatgtcaccagcgataacgcttcacgaacaaagccgcggatcaggctaaccagagaggaaaaagcaatcaccgcgattatggcgtaatcaatccagaccatatgtgtcccacgattttacgccctgtcatcctgttcggggcgcattctaacagaaaaagaaaacgtttgcgtagggatttccttcccgcgcatcaataaaaatggcgctgaaaaaatattcaacgccatcgactttttatgcctttgcggcatcgggcaatgcgtgtcggatgccgcatgaacgccttatccgacctacggttctactcctgcgtaggcctgataagacgcgctagcgtcgcatcaggcaacggctgtcggatgcagcgtgaacgccttatccgacctactgttctacccctgcacaggcctgataagatgcgccagcgtcgcatcaggcaagaccgtattaattcggtgtatagcccattaccacgccacttaagccagaaagctgcttgagctcacccagcgatcctttcagcttctctttggaagcatccggcccaaccagaatacgggtaattttaccctgcactggcgtggatggcgacgtataaacccgataaccggcaccgcgcagcttaccgacaatctcattcactttatcggcatttttcagcgcgcccagttgcacaacataagctttacccgttggcgctgctttttcttccacgaccggcttcggttctggcttcggcgcaggtggtgcttcaacctttggcttaagcggctccaccggtttcggcttcggtggggcgaccggtgcaggttccggttcaaactcggtgttattggctgcaatagtggccggatcgagcgacggtgctgcggcatcacctgcccgtacctcctccgctgcgccttccggcggctgcgtcggcaacgcctgggtggcggctggcatcatatcaggctcatcgcgatcgcccgcttttggcaccaacgggatagccgcgaactcatcctgataatgttttttctgcccgtccagcagccctggaagtacaatcacccccagcgctaccagcacgatcgtgcccactaaccgattctgaaacttacttgccaccgcttctcctcgcgtcaatcacttccatgacatgtgcgaccgtgtggaacgaaccacacaccagcacggtgtcttccgctttagcgtccgccattgcggcatcccatgcctgcgcaacgctatcaaatgatttgccgttacccaaatgctcaagcagttgttctgccgtggcaccgcgcggcccttccagtggcgcacaataccagtcatcaaccacgcttttcaaccaggccagagttccggcaatatctttatcatgtagcataccgataaccgccagcacgcgcccgtttttcggtagcgctttcatacgcccggtgagatattccgccgcatgtggattatgcgcgacatcaaaaataacgcgtggcgactcgctcacaatctggaaacgtcccggcaaaattgcgctggcaattccgtcgcgaatggcattttcactgacctccagcccgctggcacgcagtgccgccagcgccgttgcggcattcggttgcgggacaagcggcaacggcagattttccagcgtgccgtgagcatcgctaaacgtccagtcatgatcggtgacggaatagttccactcaacgccccgacgttgtagcagtgcacctttttcctgcgccacatcagcaatggtagaaggcatctccggctcaccgacaattgccggtttttcgctgcgaaagatacctgctttctcacgaccaatactttcacgatctggccccagccagtcggtatgatccagcgcaatactggttactaccgcgacatcggcatcgacaatattggttgcgtccagacgaccgcccagccctacttccagaatcactacgtcaagttgtgcctgcttgaacagccacaacgccgacagcgtaccgtattcgaaataggtcagggaaatatcaccgcgtgccgattcaatctccgcaaaagaagcggtgtgggccgattccggcaattcctgaccctgcacacgtacgcgctcggtataacgtaccagatgcggcgaactgtagacgcccactttgtaccctgccgccatcagaatcgactccagtgtacggcaggtggtgcctttgccattcgtacccgcaacggtaaacacaaatggcgctggtttcagaacgccaagacgcgccgcgacctggctcacgcgctcaaggccgagatcgatagttttactgtgcaggttttccagataagaaagccacgaagccagaggcgacgcggcttgaggagtgcgtttgataatcatggtatccgctgattcgttacggtgagaatagcaaaagggcagagccagtggccctgcccttatcagttatcaggcctcaggttcctgatccggtaccggtggcaccactacgccttcacgcggcgcttcaggattcggcgctggcagattcatcaacttcgccagaatgctcgccagtttcagacgcatttccggacgacggacgatcatgtcgatcgcgcccttctcgatcaggaattcactgcgctggaatcctggcggcagtttttcgcgaacggtctgttcgataacacgcggaccggcaaagccgattaacgctttcggttcagcgatgttgagatcgcccagcatggcgaaacttgcagaaacaccgcccatggtcgggtcggtcagcacggagatgtacggcaagccgcgctcctgcatttttgccagtgccgcagaggttttcgccatctgcatcagcgacatcagtgcttcctgcatacgtgcgccaccagaggcggagaagcagatcagtgggcagttatcttccagcgcctgctcaacggcacgcacgaaacgcgcacccacaacagaccccatggaaccgcccataaaggcgaactcgaatgccgcagcgacaaccggcattccatacagggtgcctttcatcaccaccagcgcatctttttcgccggtttctttctgcgcagatgccagacggtctttatacttcttggagtcacgaaacttcagcacatctttcggctcaagctcgctacccagctccacaaggcttccttcatctaacaggctatgcaggcgattacgcgctgtcatacgcatgtgatggtcacacttcggacagacctcaagattacgttccagctcagcgcggtataaaacctgaccgcagctatcacacttagtccacaccccttcaggaatgctcgccttgcgggtgggagtaatgttgcttttaattcgttcaatccagctcattagggacctttctgtctgaacctggttcgatgccagttttatctttggggacgcataatgccatttttgcccccaacagaccatgaatgttgcacattaaaacataacagcccgaaactttggataaaaaagtggtcgaaccgcagagttactttttattttgcggcgcgtgccgctgcgcgtttgtggcgaataaattcgaaaacacctggcaatattgaaacaaaaataatgccaacaatcatcagtttaaggttgctctgaatgaaggggagcgtgccgaagaaatagcctgcgtaggtaaaaagcagtacccacaacagtgcgccaatcacgttataagcggcgaaatgacggtacgacatatggcccattcccgcaacaaacggggcaaacgttctgacgatcggcacaaaacgggcgagaataatcgttttgccgccatgtttctcataaaactgatgggttttgtcgagataactgcgacggaaaattttcgaattgggattactgaataacttttcaccgaacaaccgcccgatagtgtaattgaccgcgtcacccacaatcgcggcgatcagcatcagcaccaccatcatatggacgttgagatcgttggtctccagtgatgccaacgctccggcaacaaacagcaatgaatcacccggtaaaaacggcgttaccaccagaccggtttcacagaacaaaattaagaacaaaatggcataaacccagacgccgtactccgcgaccagctctgccagatgcacgtcaatgtgcaggataaaatcgatgaggaaataaatcaggtccatatttgcctatgccttgtactcgtcatctatcaggctgtaactacgttggctacagcctgaaatgttccgagcattattctcgttagtccgccagaaatagcgggcccattggcggttttggaagatcatatcggtcagggtaatccaccgcgaccagatatagcccttccgcttttgccgttgctgccgccagcgttctgtcctttgccgccagcaactctgctatccagctctccggctggttgtgggcaccgacttccatcaggctgccgacaatattcctgaccatatgatgtacaaaggcattcgctttgatatctaccaccacataaggaccgtgacgcgtgacattaatatgcataacgttgcgccacggggtccgggactggcactgcaccgcacggaacgaggtgaaatcattctcgcccagcaagcattgcgcagcccgatgcatccgttcagcgtccagcggttcgtaaaaatgggttacccctttactcaataccgccgggcgcagccgatgattgtagatgatgtagcgataacggcgagccgtggcgctaaatcgggcatgaaaatcatcaggtacagctttaacccaacgcacggcgatgtcaccaggtaaattcgcatttacgcccaacgtccacgcagcgtctttgcgctgcgcggtcgtttcgaaatgcaccacctgcccggtaccgtgtacaccggcgtcagtacgcccggcgcagaagacggtgatgggttcgttcgccacctgggagagcgccttttccagcttctcctgcacactgcggacttcattctgccgttgccagccgtaatacctactgccgtcgtactcaatgcccagcgcaattttataaactggcggttgttgctggtcggacattagtacagatactcctgcaccagtttctcggcgatttttactgccatcagcgcgccgccaaagcgaacgttatcggccaccgaccagaactggacttgctccggcataccgtagtcattacgtacgcagccaacagaaagatgcggcgtaccagaagcatcccctacctgagtcgggaattcgttctcttcagagagcacaatatcttcgccctgagcaaacgcatcacgcgcttcttctgccgccagcggacgcagtgcttcaaagttgaccatctgggcatgaccgtagaataccggtgcctggacgacgcttgccgaaatcatcagcccttcgtcctgcaggattttgcgtacttcgtcaacgatacgacgttcttcacgcacgctaccttcgctatccggcagtaacggcagcatgttgaacgccagctgacgcccgaagaaatcttcttcgtcaatcggaatgccattgagtaatttagcactctgccccgctaacgcatcgaccgcttttttaccctgggcggaggctgaaatcaggctggtaacgctgatacgtgataaaccgccctgatcaattagcggtttcagtgccgccagcagctggctggtcagactgtctggtacggcgatgacattccggttgcggtaatcggtcagtacaaacgggtttacttccggcaccaccagcggtacgtcaggttcgagagcaaacaatccgctgctgtcgatcaccagacaacctgagttggtcgcttcttcaacccaggcagcggtagcttctttgcctgcgacaaaaaacgccagctgcgcctgcgtccagtcaaattcagcggcatcctgcacggtgattgtcttaccaccaaagcgcagttgttcgcctgcgctttcgttacgtgccagtgcataaatttccccaaccgggaactgacgttcagccagcgtttcaagcagggcttcgcccacagcgccagttgcgcccaggacggcaatgttccagccttcagacatggtggtttactccagaaatagcaaagctccctgccaatgttacagcagagagcatgaagaagagattaacgtgccggatgatgaacggcgttaaaacccagtttacacagcaatgatgccgcactggcgtcatcacaaattacatacagagatgaccattcacggcgctcaagatagtttttgcgcagtttatcgaactcacccggtatcccggcgactttacgcagcggtgcgtcatcgcggcgcacatcatacaccaaatgcaccagccttttcagcgttggctgatcgagcgggccatgcagcgtaatgcgaccaaactctggcgcgggcagtaatgtatccagtgcaacgtgctgttcatgcccaataaacttgctataagcttcaaacacttgcgtagtaccgcgtgctttaccttccagggtatagcctgcgatatgcggcgtgccgatatccacttttttcagcaattccacgttaagttccggttcgccttcccagacatccagcactacgcttaacttctggccttcgttcaggcaggtcagcagggcggtattatcgacgactgcgccacggcaggcgttaatcagaatcgctcccggtttcaggctgcggatcagtttttcatccgccagatgcagcgttttgtacggaccatctttaaagagtggcgtatggaaagtcagaatatccgcatgctgggctaactcattcagcgagcggaaatccccctcatccccacggtcggcgcgaggcggatcgcaaagcaaggttgtaatccctaacgcttccagtcgcgcctgtaaacgacgaccaacgttaccaacgccaacgatccccacggtacgctcgtgcagtgaaaatccatcgcgttcggcaagcatcagcagggaggagaaaacatattccactaccgcaatcgcattacagccaggtgcagcggaaaaaccaattcccgcctgctttaaccatgcttcatcgacatggtcggtccccgcggtggcagtgccaacaaatttaatgggttttcctgccagcaaagattcattcactttcgtgaccgaacgcaccataagcgcatccgcgtctgccagttgagcgacgggaattggacgcccgggaaccgcggtcacctcacccaaacggctaaataagtcgcgggcataaggcatattttcatcaacaaggattttcacgtttgtgttacctgtatgagacgagagttaaccagacaagtgtgccataatctcgcggccaggcatacttgcgaagatttcaggtataaggatacgtaatgatacaacctatttccggccctcctcctgggcaaccaccaggtcagggagataacctgccgtctggcgcgggcaatcagcctttatccagtcagcaacgtacttcgctggaaagcttaatgacgaaagtgacctcactgacgcaacaacaaagagcagaactgtgggcgggtatcaggcacgatattggtctgtcgggagattcaccgctgctttcgcgtcacttccctgccgctgagcataatctggcgcaacgtctgttggccgcgcagaaaagccattctgcccgccagcttttagcgcaattaggggagtatttacgtctggggaataatcgtcaggcggtcacggattatatccgtcataactttggtcagacgccgctgaatcagctctcaccggagcaattaaaaaccattctcaccctgttgcaggaagggaagatggttattccgcaaccacagcagcgcgaggcgaccgaccgtcctttattaccggcggagcacaatgcgctcaaacagctggtgaccaaacttgcggcagcaacgggggaacccagcaaacagatctggcaatcgatgctggaactttccggggtgaaagatggcgagttaattccagcgaaactgtttaaccatctggtgacctggctacaggcgcgtcagacgctaagccagcaaaatacgccgacgcttgaatcactacagatggcgctgaaacaacctttagatgccagtgaactggcggcgttatcggcatatatccagcaaaaatatggcctttctgcgcaatcatcgctttcttctgcccaggccgaggatattcttaaccagctttatcaacggcgggttaaagggattgagccgcgtgatatgcaaccgctgcttaatccttttccaccgatgatggacacgttgcaaaatatggcaacgcgtcccgcgctgtggatactgttagtcgcgattatcctgatgctggtctggctggttcgttaaccccgacgaaacgacagtatcgtgacaataattcccagcaccgcagagatcgccccggcaagaaataccgaagagtaaccaaacatggtcgccagcattcccgcaagcggcccggagacgccgagggcgatatcctgaaacgcggcgtaaccgcccagtgcggtgccgcgaacgtgtgaggggacgcgtttaaccacctccacgcccagcgcaggaaagataagcgaacatccggctccagttaacgccgcgcccgctaatgcgacccacgcccctggggcttgccagagcagcaacaagcccaccgtttctacaagcagagagacgatcgccactttcacgccgccaaaacggtccggcatccagccaaacatgacgcgcatcacgacaaatgcgccgccaaacgcggtaagagtaaagcccgccatcgcccatcctttgctggcaaagtagagcgaaacgaaagtcccgataaccgcaaaaccaacgccttgtagtgccagacctaaccctggtttccagataagcccgacaacgctccacagcgatggacgttcccccgccagggccggtactttgcgcactgtgccgttacaggcccacgccagtaagggtaatgccattgtggtgagcgccagtgcggcaaaaccgtaatggctatgaatcaacaggccaagcggcgcaccaacagcgagggcaccgtaaatagccattccgttccatgacatcactttgccggaatgttttggcccaacgatgcctaatccccaggtcagagcgcccgtcagtaactggctttcaccaaagccaagaatcaaacgcccgacgaccaacagagcaaatttgaacggtgcggggacgggcaaaatcgccgccagcagcaacgcgccccccgccagaccacaagctaacatcccctgaagcgccgaacgttttgcgccatattgatcggccagtcgcccggcgtaaccacgcgtcagcaccgtagccagaaactgaatcccgacggcaatgccgaccatagtgttgccatagcccagttcatgatgaacaaacagcgggataaccggcaacggtaaacctacggtcatgtaggtgagaaaaaccgcaaaagcgatgcggaagagcgaaaaattggcagaagatcgtgtttcggtttggcttacagcagtcatgcattactccagaatgcagcgcaaggcgaggagtatccccgtctcatctctctggtttcagggttacggtgcgttggcaggatttaacgcgtacgtcttttctgcaggaaatcgacaaagcgggaagtttgcctggaactggcggcgattgtcaatgatgtgaaaaagggaaccatcgggttcccttttgcgttagtgccggaggcagcattggcgcgtaacgtcggatgcggcgctggcgcgtcttatccgacctactccgaattaatctttcagcttgcgcattaccagcgtggcgttggtgccgccgaagccgaagctgttagacataactgtggtcagttcgcgatcggtcgtttcggtcacgatgttcagacccgcagcctgctcgtccagctcttcaatgttgatgctcggggcgataaaaccgtgttccagcatcagcagagagtagatagcttcctgtacgccagcagcgcccagtgagtgaccggtcattgctttggttgcagaaatcgccgggctcttatcgccgaacacttcacggatagctgccagttctttcacgtcgccaaccggagtcgaagtaccatgagagttcaggtagtcgattggggtatcaacaccgtgcatcgccatcttcatgcagcgtactgcaccttcgccagacggagcaaccatgtctgcgccgtcagaggttgcgccgtagccaacgatttcagcatagatgtgagcaccacgcgccagcgcgtgttccagctcttcaaccactaccataccgccaccgccagcgataacgaaaccgtcacggtgagcgtcgtaagtacgggaggctttttccggggtgtcgttgtatttagtagacagcgcacccatcgcgtcgaattcgcaagccatttcccagcacagctcttcgccgccgccagcaaacacgatgtcctgtttgcccagttggatctgctctactgcgttaccgatacagtgtgcggaagtcgcacacgcggagctgatggagtagttaacgccgtgaattttaaacggcgtggcgaggcaggcagaaacgccggatgccatcgctttggtgaccacatacgggccaaccgctttcaggccgcgcgggccgcgcattgcgtcagcgccgaacacctgaaaacgcggggaaccgccgccggaacctgcaatcaggccaacgcgcgggttattctggtaagcttccggggagaggccagcatctgcaattgcctgctccatagaaaggaatgcataaatggatgcgtcgctcataaagcgcacaactttgcggtcaatgaggccagtggtatccagttttacgttgccccagacgtggctacgcatgccggaatccttcagctcctgagagaaagtgatccctgaacgtccttcacgcagagatgccaggacttcctgctggttattaccgatgctggaaacaatgcccaggccagtaatcactgcacgtttcattcaatacctctgtaagtcgcacatagagtaagtttcgaatgcacaatagcgtacacttgtacgccgaacaagtccgatcagccaattaatagagaaatttgcgcagcctgacacacatcgctaagatcgagccaccgcctgtaagacgagtaacttacgtgaaacactacgccatacaacctgccaacctcgaatttaatgctgagggtacacctgtttcccgagattttgacgatgtctatttttccaacgataacggactggaagagacgcgttatgtttttctcgggggtaaccatttagaggcacgttttcctgaacatccacatcctctgtttgtggtagcagagagcggcttcggcaccggattaaacttcctgacgctatggcaggcatttgatcagtttcgcgaagcacatccgcaagcgcaattacaacgcttacatttcattagttttgagaaatttcccctcacccgtgcggatttagcgctggcgcatcaacactggccggagctggccccgtgggcggaacagcttcaggcgcaatggcctttgcccttgcccggttgccatcgtttattgctcgatgaaggccgcgtgacgctggatttatggtttggcgatattaatgaactgaccagcaaactggacgattcgctaaatcaaaaagtagatgcctggtttctggacggctttgcgccagcgaaaaacccggatatgtggacacaaaatctgtttaacgccatggcgcgactggcgcgtccgggcagcacgctggcgacctttacgtctgccggttttgtccgccgcggtttgcaggaagccggattcactatgcaaaaacgtaagggctttgggcgcaaacgggaaatgctttgtggggtgatggaacagacattacccctcccctgctccacgccgtggtttaaccgtacgggcagcaacaaacaggaagcggcaattattggaggcggtattgccagcgcgttgttgtcactggcgctattgcgtcgcggctggcaggtaacgctttattgcgcggatgaagcccccgcactgggtgcttccggcaatcgccagggggcgctgtatccgcttttaagtaaacacgatgaagcgctaaaccgttttttctctaatgcgtttacttttgctcgtcggttttacgatttattgcccgttaaatttgatcatgactggtgcggcgtcacgcagttaggctgggatgagaaaagccagcataaaatcgcacagatgttgtcgatggatttacccgcagaactggctgtagccgttgaggcaaatgcggttgaacaaattacgggcgttgcgacaaattgcagcggcattacttatccgcaaggtggctggctgtgtccggcagaactgacccgtaatgtgctgaaactggcgcaacagcagggtttgcagattcattatcaatatcagttacaggatttatcccgtaaggatgacggttggttgttgaattttgcaggagatcagcaagcaacacacagtgtagtggtactggcgaacgggcatcaaatcagccgtttcagccaaacgtcatctctgccagtatattcggtggccggtcaagtcagccatattccgacaacgccggaactggcggagctgaagcaggtgctgtgctatgacggttatctcacgccacaaaatccggcgaatcaacaccattgtattggtgccagttatcatcgcggcagcgaagagacggcgtacagtgatgaagatcagcagcagaatcgccagcggttgattgattgtttcccacacgcgcaatgggcaaaagaggttgatgtcagtggtaaagaggcgcgctgcggtgtgcgttgtgccactcgcgatcatctgccaatggtaggcaacgtgcctgattatgacgctacactcgtggaatatgcgtcgctggcggagaagaaagatgaagcggtaagcgcgccggtttatgacgatctctttatgtttgctgctttaggttcgcgcggtttgtgttctgccccgctgtgtgccgagattctggcagcacagatgagtgaagaaccgattccgatggatgccagtacgctggcggcgttaaatccgaataggttatgggtgcggaagttgttgaaaggtaaagcggttaaggcggggtaatctgctttggcattgtttgtcggatgcggcgtaaacgccttatccgacctacgcgttacctgtaggcctgataagacgcgataagcgtcgcatcaggcatggtgctccagacgtcacagcttactgctgtgaggcctgctgaaacaggtgttcccacatatcggtaaccagcgcctggtcacgcggtgacaattcacccgcgccaatggctttttccagactctggctaacggttgtatgtaccgcctgagcggagtggtcgtcaccactttccagttctgcgatggctaatgtcaggtggccacgcaaatacccactggcaaataactcatcatcactggcatggtcaaccataccgtcgattaatgccagaatgcgtgattcaaactccgcgatcatcttctttcctcattgtaaaacgtggcgctggcttcagctgagcgcttccggccacgggaattgttccgccgtaagttccggcgtgtgataataattttgtagtgctttaatgaagcgtgccggacgttcgggaatgccgtttgccagataatccatcacctgcgcatgtacccgccgttgaaacaccacgcggtccggttcgaaatccccttccagattgtcgcagctaacattaaacggatatcccgccgccacgcagaacaaccagtccagcgcctgcggcttcacttcaacatcttcaaactgactttgcgtctgggcatcgcgtccgtccgggcaataccagtaaccgaaatcaaccagctcacggcgcgctttcccggcaatacaccagtgcgaaatctcgtggatggcgctggcataaaagccatgagcgaagacgattctgttatacggtacttccgcatcagcaggaagatagatcggttcgtcgtcgcctttaatcagacgggtattaaattcatcggcaaagcagctattaaaaatctcaatcaactgctcatagtggtgtgtactgttcattagttcatccccaaccagtggaggatctcctgtccatggctatcgtaaagtaatttggcactcatcaccgccgagacgataacgatcatcgggcggatcagcttttgtcctttgctcaacaccagtcttgaccccatgcgcgcgccgaggaactgccccaccaacatcacaaagcccgtcgcccaaatcactttgccgccgagaataaacagcagcagaccgccaatgtttgacgttgcgttaagtaatttggcgtgagcagtggctttggcgaggttgaatccgcacagcgtaacgaaggccagcgcgtaaaacgatccggcagccgggccaaaaaatccatcgtaaaaaccgacacaaccacctgcaattaacgcgaagggtaaaccgtacatccggcgctggcgatcttcttcacccagctttggcatcagtaagaaataaagaccgatacaaattacgaggatcggtaaaatctgccgtaagacatcggcctgaacatactgcaccagtagcgcgccgctcattgagccgacaaaggtcatggcgatattgagtttttgatcgcttaaactaaccactttacggcgaataaagtagatagtggcggaaatagagccaccgcaggcttgcagtttattggttgccagcgcgttagcgggagacatccccgccgccatcaatgccggaatggtgagtaacccaccgccaccggcaatcgagtcgataaaccccgccagcatggcgacaaaaaagagaactcccagcagcagcggggaaaccataaacaggctattaaacgtttccattagatcacgtgctcatccagtagcgcctggcaggaaggcggcaacggaggcggtgtcttcttctcaggctttgttgttcccggttttggaggttcaaaccagctttgcagttctgccccgcaaccatcgcctggtggcggtaaaggttgatcctcacactccagactatcggcaggacaacgtaatcgtacatgcatatgcgcgcgatgctggaaccagggtcgcactttgcgcaaccagtcgcgatcggtgcccgcatcaaggcaaagttgttgtttaatcgccggattaacaaaaatgcgcgtgacgtctttgtcctgggcggcgagtttgatcaagctgaaaatttctggcttccacagcgcggggacaacgtgtttaccgtcgcgggaaactaaatctaacgcttgcgggcgcaagagctgcgcggaggtccagcgtgttttcggcagttgcaggaagatatcgacatccagtccggtctggtggctggcgtgaccgccgttgaaacgaccgccagcaggcatccccatatcgccaatcagcaccgtacccatgccaagattgctcacctggcgactcagacgctggataaacatcaccaggtctgggtgaccgaaatagcgacgctgatcggtacgcatgacctgataatgttcggactgtatcggcaacgtgtcagcgccgacgatacagccattagaaaaactgcctatcgattgtgcgctacccggcactggttgggttattttttgccacggcgtcgctgccaggctggcactactggcaagcagagccagcagcgcaatcgcggttttgttcattttttaccagcgtggaatatcagtcttcacatcggcattttgcgcccgctgccgtagcaggtgatccatcaaaacgatcgccagcatcgcttctgcgatcggcaccgcgcggatcccaacacaaggatcgtgacggcctttggtgatcatctcaacttcttcgccaaagcggttaatagtgcgccccggcacggtaatgctggaggttggcttcagcgccatatgggcaatgatttgctgcccgctgctgataccaccaagaatgccgcccgcatgattgctctggaaaccgtctttggtgatttcgtcgcggttctggctgccacgcagcgctaccacgtcaaaaccatcaccaatttccacgcctttcaccgcgttaatgctcatcagcgcatgggcgatgtcggcatccaggcggtcaaagaccggctcgccaagtccggcgggtacgccactggcaacgacggtgactttcgcaccaatagagtcgccttcttttttcagcgcgcgcatcagttcatctaacgcgtcgattttgtccgggtccgggcagaagaatggattttgctcgacctgagaccagtctttgatttccagtggaatgtcgcccatctgggtcaggcaaccgcgaatctcaatgccaaatttctcggcgagatattttttagcaatcgcccctgccgccacgcgcatagcggtttcacgggcggaagaacgtccaccgccgcgataatcgcgcaggccgtatttttgttcgtaagtgtaatcggcatgacctggacggaaaacgtccttaatcgcactataatcctgagaacgctggtcggtattttcgatcaacaatccgatgctggtgccagtagtaacaccttcaaaaacaccggagagaattttaacctgatccggctcgcggcgctgggtggtatagcgcgatgtcccagggcgacgacgatcaaggtcatgttgcaggtccgcttccgtcagcggaatgcctggcggaacaccatcgacgatgcagccgagcgccagcccgtgcgattcgccgaaggtggttacgcgaaagagttgtccaattgtgtttccagccatcacggctccgttattgttgtgtttgcgtgtttacttaatctttataaatcgcgaaatgttcacgggccgccagcagctgctctttggtgagcataaacacaccatcgccgccgttatcaaactccagccaggtgaacggaacatccggatattgttccataagatgtaccatgctgttgccgacttcacaaatcagcacgccatcatcagcgaggtaatctgccgcgttaccgagaatgcgacgcgtcagtttcaggccgtcggtgccagatgccagacccagttccggctcgtgacggtactcatttggcaggtcggacatatcttccgcatcgacatacggcgggttagtgacaatcaggtcgtactgcactttcggcaagtcgcggaacaagtcggaacgaatcggaatgacgttatggatcagaccgtgttcttcgatgttctgttcagcaaccgccagcgcgtcgggagagatgtccaccgcgtcgacttccgcttccgggaaggcataagcacaggcaatggcgatgcagccgctaccggtacacatatctaaaatatgctgcggttgcttgctgatgagtccggcaaatttattgttgatcagttcaccaatcggcgagcgcggcaccagcacgcgttcatcgacgtaaaattcatggccgcagaaccaggctttgttggtcaggtaagccaccggaatgcgctcgttgacgcggcggatcacgcgctcaacaatacggtgtttttcgctggaggtcagacgcgcggtgcgcatgtcttccggaatatccagcggcaggtagagcgaaggcaacaccagttgcacggcttcatcccacgggttatcggtgccgtggccgtaccagatattcgccgcgctgaagcggctcaccgaccagcgcaacatgtcctgaatggtttgcagctcatttactgcttcatcaacgaaaattttatccacgtattcctccagggcatgatcgcaataatttcggcggctagtttgccatgaagatgacgataaatcagcattcacgcgcggtgagtgaggaaaaatacgtttaaaacgatcgattgtgctacgagtcgggtaaactgtaggaaaattagaaatagagaaagataaatgaaaaagaaaacaacacttagcgaggaggaccaggcgctgtttcgccagttgatggcgggtactcgcaagattaagcaggacacgatagtccaccgaccgcagcgtaaaaaaatcagcgaagtgccagtaaagcggttgattcaggaacaggccgatgccagccattatttctctgacgagtttcaaccattattaaatactgaaggtccggtgaaatatgttcgcccggatgtcagccattttgaagcgaagaaactgcggcgcggtgattattccccggagttgtttcttgatttgcacggtctgacgcagctacaagccaaacaggaactgggggcgttgattgccgcctgccgccgtgaacatgtgttttgcgcctgtgtgatgcatggtcatggtaagcatattttgaagcagcaaacgccactgtggctggcgcaacatccgcatgtgatggcatttcaccaggcaccaaaagagtatggtggcgatgcggcgttgttggtgctgattgaagtggaagagtggttgccgccggaattaccctgaacattaaaaggtggatgagtcgggccatttagccttgaatactggcgtctcacccctggcaataatgaacgtaataatcgggcattaattgaaaaacgtaagcagctttccgacagccttctgtgggctaatggcattgccccttcagaggggcttgaggatgacgacctgctgcaagcgcttatcgacgaattactcaccctcgttgacggttatctggcacctttcgctcctgtggtggcgaatattctaaaaaactggatgaccgcatgacataacggacaacgggaccagatggccccgcatcgtgtgtggtgtatacgctacagctcgttgagcgtgtactggaagcggcaggtggaatcaatcggctggcggctgctggtatcgacacgcactaccatgtcgtgcagttgcttgtcagtgatgggatgctggttgggtgtgaccgtcactttcgaactgtcacagccggaggtggagaaggtgatcatctgcgccacaaagcggcagtatgcgcctcgatcgtccatcacgctgccgtcacagagcttgccgctttccatcaaaaaggtgggcagcgttttctcaatcgttccacccgtcgattgcagtgacagcactttcgaatggacaacataatcttcactccacgaaatatcataagcggcgacggagacggggcatgatgagttgtgaactttggggccaatatatagaccaacaccatctaccgaagagatattgctgtcagtatatgtcgagatcaaccacgggcaaccgtgcacctcaccatcatagtacactccgaggctggcgttgtaacagatccaatcagatttactcgaccgagcatcatacgcgtcaagaccaacacaggtagattttgaagcatcattgagctcctccattttcaacgtcggtgcggcggtactccctgtccaggaaactaaatctaaattctcagcttgaagcacaatactgtgttgcttataaacgccatactcaaccccttcaggggtcagaatttcaagataataacgtatctgtgttagataccccgaatatgccaccggggtcaccaatgtcgcaattttcttcgctgccagactttctgctgcgcaagtcagcatgaccaggcagcacaaccatcggaatattttcattttatatgtactcaaatgtcgcagtcagggaggcggtaaaatcccccatcgtcacttcccggccgcttttcgcctggagccaggcattaaaattcagattgttattgccgttactcagcacaaaggtcgcgccgctggtattgttaatcggcaccggtgttccatcggttttttccatgccaattccgacaccttgcgccgccgaagatgcatccagcgccagaaaaccgggctgttcgctgtcttccgtgccggtgagcgtcacccgaacctcatactgggctggccctttgcaatctttcagctgaaacactaccggcacccgcgccgactgcccggtcaccatcaggtctttacggctgatggtgggaaaatgcacctccgccagcgactcgccctgaacgactaacgtgcaggacttgctgagtaaattgccgtagaaatgcaggttgtcagccgcctgaacatggggcgtcagcagcaccgccgccagtgcagccgcgcagtgagatatccgttttaggttcattggtaatccacctgtaatgttgcgtaggcagaaaaggtgccttcgctgagcgccgcatcattggctttcaccggcacagcttgcagcgttggcggcgttgacgggtcaattttcaacggtgttcccagcttaaacggctggccgttttgctgtagctcaatccccaggccgctaacgtccgtttcaatggcggaatcatcataaggggtttggctgcccgtccaggtcaggctcatctcccaggcgtcgtcgcgcacatcggggtcacatgtgatggtgtaaggcacatcctgacggaaattatcgccgttaatgttgtcgataatgacgttgcgaaactcaacttcgatcgtcttaccatcgctgatagtacaggcgggtggcgaaaccagcgtgccgtgaaaagtaacgtcgttaatcgcggcctgcgccaggccagcaaaaccgtaaattaagcaccatgcgagtcgtttcattggtagtccaccaccatggtcatggtcgcgttaaactccgatgccatcagttgcacaccgctctgcttcaccggaacggcttcgaagtctggctgtgtattgatgttgaacggcagccagctactgttacccactgccaccagcgaatggtcagcggcattctgaatacgaatgccaaaaccgctgattccagtactcagcaccgtttcgccgttgatggtcgtggtggtggcctgaagctgcatttgcaggtcgtcgctgacactgtttgagcagttcagggtgtagcccactggctgacggtagttggcaccatcaatgcttttaataatcacattgccgaactccaccgcgcttccctttaccgaacagggcggcggcccatccaccagcacgcgcaacgtcaaattgacgattttgccgcccgccattgccgggaaaacggtcacgccacaggccagcaatagcgcggcagatccggtcagaaagaacgctttcatgttgcttctcccgttatcaacctttgctgctttgatcttcatccaccttgcaggtgttcccttcacaacggaagatcagcggcatgcgcgcgccgtagtcgttgatataggtcagcaccggggcgctcgccatttttgcctttaacggttgtgacgttttcggtggcatcaccagcggtttaaacccggcggcagtcagccctttcttctgtgtgctggcatcgctgatgatgacgtggtacggcgtcgggttattgacggtatagtcctggccgctgcgcgtgagtgtgaccttaaactgccacggttttctcatgtcaatcttttccagcgcctttggtcgccagaacagcttgatgcgcgtttgcagcgcaatttgcagggtgttggctttcccggactttggcgggatctcacgcacgttgtagtagaacaggctttctcggtcggacggcagcgtgtgaatgtccggcagcgcctgaatcttcacctggccgttcatcatagcgtcaatacgctgcaccggcggcagcaccgccagcggcgaagtgattttgttgcccttctcgtcttccagccagctttgcgccaggtaaggcagcttttcgttgttgttacgcaacgtcacgctgatcgatttatcgctttcgttaaacaccagacgggtgcgatccggggtgaccgatgcatgcgccgtcaggctggcggtggtaagctgtgccatcagcgctgtgctgacgagcattggacaggataatttataagacattgatcgttccttaatcagattattgagttgctgaaattgacctcggcgcttccgttggtgtgacttgccgcgtctggccctgaataacaggcttaatttctggcgctgaagaatcaggggctgccgttcccttttgttcacacggcaacaacaggccgctgaacaaatcggcaggtagcggcttcggcaatacgatctcgcattgtgcgctgccttcccagaacaccatcatatgctcgtccgcattgacccccgccagatagacattgccttcatcatccacaatgccaacctgctgctgctcgtcgtttttcacttccgcgccaaacggcgggtagctaccgtcacgtaaccgcagtaccgccatcgctttttgcccgctgatcactttgaatttacgatagccgattgcgccttccgtcagagtcgcctgcaccaccgactgggtggcttccgcatcttccggcaggttgtttaaatcgatatacgcctgattgcgatagtagttgttaatatcggcgaccaccgccttgccaaacatattggtgtacaccggcgcgccgttgctttcgaccggcacgttggcaatcccgtcggcgtcaatcagcaggcgcgtgccgcccatgttctgggtacggtgcagcgccccaccatgcgcggtcagcgttgccccgccctgtaaggcgatccccgccgaacggtattccccttcatggtagttggcgctgagatcaaccttcgccagcgaaccgtcgtggctcagataaccatccgcgctgccgtgctgctcgctggtgccaacgttaacctggtagtgcgttgcgtcatcgacgcgcttaaagtaaccgacctggctgctgtccgacccgctgccgtaggaaccgttgtaggtcacggtgctgctgtcgctccacggaatgctcatactgaggtacatccccttatccgcattatcgtcatattcgtagcgatagccggtcaccgagatgctcatgttgcgaatgctccccatattaaaatagtgggaaaacatcaggttatagtttgtctgttccgggcgatcccagtaagtacgatgggagtagttgagatagatcgagacacccgcagcggcaaagttctggttataggtgatcgtatacatctctttgtcgttaccggtccgcgccatgtctgactggttcgcgtccagatactcgctcatggtcatgaagttcttttcagaaaaacggtagcctgcaaaggtgacgcggctgttgagttcgtcaaagtctttggcatagctcacgcgaaaggagttgccgtccagttttcctttgccatatgcgctgtcatgatccaggttgacgtgcgagtgagtcacatcgaacgccagcgcgccaaactgtgcgaggtcgcgccccacccccatcgccgccgactgatagtgtttatctgccagcgcaccaccgtagagcgaccagccatctgccaccccccatgacgcttctccgccggagaaaaagccgccttcggtcttgtggttccagtcttccggacgccccatcatcactttgtaacgcacctgcccctggcgcgtgaggaatggcatagatgcggtcgtaacgtcatattcctgcacctgaccattctgttcttcaacgcggacgtgcagtgtgccggagacggagtcgccgatatcctgaatgcggaatggcccggctggaacctgggtttcgtaaagtacccggcccatctggctaatggtgacttttgcactgctgtgcgccacgccggaaacatccggtgcatagccgcgcaggttgggcggcagcatctggtcatcggtgctgacgctgctgccgatatagttaaagccgtcgaaaatatcggaattgagataatcttcccccagcgacagcttcgcttttaaagagggcaaggctcgccaggcgtaataacgactccagtcccagtgtttactcgttgtgctgttactgctgtcatcgtcgtcatcgttgctgcgggtgtgctgataatcactttgccagtctgcacggaaacgccatgcccccaggttcgccccaacggtaccgttgccgctgatatcatgtgagtcctcgcccccctgctcctggtggcgagtttgcgcattgaggctgtagtcggcaatcaggccaggaataccgtcgtcccaacgtgagggagggtcccagtcgctgctggtatattcgaggtaagcctgtggcactgtcagcagcaacgccgactggcttaaatcattctcgacttccatcccgtctaattgccccggtttaaggcattcatcgttgtgcgtccactgcaggctttttgctatcccttctttcagccccagcgccgccactaactcaggtgtcaggcaggcatagttttttgttggatcgttttcagagacgtaccagttaatgtcgtattcatcagaaagggggtgtttatttataaatacacgtaaattatatttacccgcgtcgacataccctttttttgaaaacttaccgagatcaattttcgtatcgccctttaactcaaggaaacgggggtcaaattgaattgaatcatcagcccatgcattgactgacccaccagagattgccagcgcaatatagcaggcgattccccgcagccgaaaatttgagtgattaggcatacacatatccgtttgtgaaacagtcgtaaatctgttgcgtgttgaataaccccacagcagaacgctgtggggttgtcacatcagagataggtaatctggaatgtggtcagggtttcgaactggccgagatccggcgcatcggtttcacccaccagccaggctttaaagttcagcgtttgcttgtctttacccttgccggttgaagtatccatcacgattggctgaacaatcttttcgcccactttataacctttgccatgggtatcgccgattaccaggctcacgtggttcatggcaacaccgctgtcaacattgaataacgcatagttatctgcgttggctggccccgcgtagttagtgccggtgaacgtggtctccatgtttgtttcagtggtaaacacacaatcctgtaaacggatttggaaatctttcggtgtggtagtgccaccgccggtcagtttagccgcaccgatgtcacccatatcgacttccagtttgtgatcgtctggaacgatagagcacggggagtcttcaatggtgccgtagaagcgcgcggtaccgttgttgcctgctgcaaaagcagaactggaaacaactgcgcccatgaccatcgacgcagcaatggctgttttggcaaacttactcattatttgtccttaaatcattaagagttataatataagcacctgacataaaattaatatatattatgcccgatatttatagttagccattgaacatatacactccaatataatcatagaatgtaaacaagtattctctggtgtgtctgtatgttggtcttatctataaaaaaactcaatttagtaatatttaaacactttatgtagattttattaattaatacatctacaaaatactttcaccactttccaacaaaaaaacatgcgaattatcaacaaaaaacaaactattataatcaacaaaaatgaattgcttataaagcacactaaaaaaaattataatgaccttaccattatttattgctaaaatttaatattaattaaatcaataaatatatattcaagacacaaaaccattatcttctttattttattacgggattcaataatgggaaaatataataactatcgagagttgttaaatattaacaacatttagacaagaaaaagaatgattgtatgacggagaaactgcccggtgtacgcgcacgtaaccgggcattgattgcttaaattgcttttgccatcttcaaattacaagggctcatttgccagttgaattggccttttccgctttcatcaagcgttacgctggcaatcgctgacgtggtaaacataggcggcgtttcgcccggacataactcggcaaccagatacccgactaacggtaagtgggagatcaccagtaccgaagcaacaccttcattggtcaacgcctgcaaataggcgccgaccagaccaacatcgccgcagggcgttaactccggcagaacttctgcactggaaggcaggttcagacaatcccctacttcttccagtgtttgctcggctcgcaggaacgggctcaccagaacgcgttcgatttccactttttgacctttcagccagttcgccatcaggcgagattcgtcacaaccgttagtggtcagaggacgaaccgaatcactggcggcatcgagggctgcgtcgccgtgacgcatgataaaaacttgcatattgcaccgcttttgttaaccagattcgcccgttttctttcatctgaaaccagaaaaagaaaacggtggccggcattgtgccttatccattcaccgaatgaaacgctgttttttacctcaatggcgtaagtatagtcaatatgcgtttacattttgagcaaaactccgccattcagcgcggattcatataactttgaccttcttattgcaggtcagttgcagttgttttccaaaaactttccccacgctcgctcatctcaactaaacgatcgcaaggggtaaaacgggaaccatactgcgtggccagtcgttgcattattgcaaccacttcgcctgcgccgagagaatcgatatagcggaacggtccaccgagaaatggcggaaaaccaatgccaaataccgcgcctatatccccgtcacgcacgctacggataacctgctcgtccagacaacgtactgcttcattcagcatcaacatcacacaccgttcagcaacctgcggtgcggagagtcgcccctgcccttgtgcgccaatgagcgggtaaatggcgggatcgacctgttttttgcttttacgccctttctgaccataaagatagaaaccccggccattttttctgcctttgcgatcgtcgttcaaaattgaagaaacaacatttgcaggcgcgctaaaacgttctccataagcggcttccagtacaggaataattttagtcccggtgtcgattcctacctcatccaaaagttggattgggcctaccggaaacccaaatttcaccagcgcggcatcgatatgctcaatacgctcgccttcggtcaacatgcggatagcttcattgatgtaaggcgctaagatgcgattgacgtaaaacccggctttgtcacgcacgacaattggcgttttgccctgttttttcgccagttttaccgtggtggcgatggtttgcgccgatgtactcgcatgaggaataatctccaccagcggcattttttccaccggactgaagaaatgcaggccaataacttgctcaggtcgcgcggcgtgagcggcgatatcgccaatcggtaaagatgacgtgttcgaagcaaagatggtatgagtagcgcaattttgctccacttccgccaccatctgttgttttaattcgagattttcaaacaccgcttcaataatcagatcgcgatgggcaaagccgcaatagtccgtcgttccggagattaatgccagctgtttgtcacgttcgctggctttgagatgacgacggcgaactttgccctcaagctgatcccaactgtacttcagcgcatgatttatgccccgcgggttgatatctttaattctgaccggaagccccgctttacaagcagtgacataagcaataccgccgcccatcaagccaccacctaaaatccccacgctgtttaatggcgcaggcggcgcatcactgccgggatcttttttcacttccgtactggcaaaaaagatattgcgcagcgcctgcgattgcggcgtcatcgccagttcgccaaacgcccgtgcttcagcgtcatagccgctgctggtgccctgcgctaatcccgtttcgacaacctccaggatgcgttctgtcgccggatagttaccttgcgttttgtgttctgttttcttaccgaccattttgaacagcagcgcacgacctaacggccccgccagaatacgctcgcgtacaggtagagggcgtgaagatgggcgatcctgctttgccagctcaacagcggcttccagcaatatggagtgcggaacgacgtcatccaccaaccccagctttactgcctgtttcgcccgaagttgttttccggtgaggatcatctctaatgctgtgctgacacctatcaggcgcggtaaacgctgggtaccgcctgaaccgggtaacaatccaagttgtacttcaggcaaaccgagcaccgttttaggatcgtcagtacaaacacgaccgtggcacgccagcgccaactccagcccgccgcccaggcaagcgccatgaatagccgcgataaccggaatgggcaaagcatgaatctccgccattaactgttgcccctgccgcgccagtacttccgcttcttgcgccgttttgcagttgccgatcatgttgatgtctgcgccagcaatgaagttgtctggtttcgcggagacaaacaccacgccacgcaactctttgttttcacggagttgcttaataatggcgcgtacctgcgaggcaaattccgccttcagggtattcattttctcacccggtacgtcgatggtgatgatagcaatgttgtccagacgaacattaagagtaaacgctgatgccatttccattattccgcctccagaaccattgctgcgccaagcccacccgcagcacaggcggtcactaaaccaaatccaccgccacgacggcgaagttcatacaatgtctgggtaatcatccgcgcgccggtcgctgcgaagggatgcccataagcaatcgaaccgccaagcacgttaaatttgctctcgtccacttcgccagtggcatgtgcacgccccagtacgtcgcgagcaaaacgttcgctacccagcaactgaatattggccagcgtctgggcggcaaaggcttcgtgcatatcgatcaatgtcagatcgcccatcgtcaatccggcacgttccagcgccagcggtgttgaccaggctggaccgagcaacatgtcctgccagacatctatcgcagtaaatgcgtagctgcgcagataccccagcggtaccagccctaattctttcgcccgggattcagtcatcaggatcaccgctgccgcgccatcggtcagcggcgtactgttcgccgccgttaccgtcccgtgtttacgatcaaacgccggacgcagctttgcgtaatcagcaagagaggaattaccgcgaatattgttgtcttcgacaagcggttgtttataaggggggataaaggcagtcatcacctcttctttgagtttaccttctgaccacgcctgagcggcacgctgatgcgaacggtgcgccagtgcatcttgctgttctcgggtgatgccgtaggttttcgccatttgctctgcggtgtcccccatccgtaatccagtggagtattccgccactgccggaggcaccggcattaagtcacgcaaacgtaagcgagaaaaaagtttcaggcgctggctcattgtgcgggctttgttgacatcaaccagtacgcgcgccagttttttactgacgccaattggcaatacggaagaggaatctgccccaccggcaatccccgctcgaatagttcccgccatcaggctttctgcgacgtttgcaaccgcctggaaactggtagcgcaagcgcggctaacgctgtaagcatcggtatgcacattcattccagtgccaagaacaatttcacgggcaatgttgggcgcttccggcatttgcacaacctgaccgaagaccagttgttcaatcacttcagcggggatctcggtgcgtgccagcagttcgcctaccaccatcttccctaaatcaactgcgggaatgccatgaaaagccgtcgcctgtcgggcaaaaggcgtacgtaaaccgctaacaatggcgatacgatcgccctggcgggtaaccagcggtaaaacctgacccataacactcccctgtaaaaaaaataaataaagtggtctgacctaatcatagtcttaaccatttttttacatttagccaagtggagaaaagggaaagtgggagctatgacacagagagaaaagaagaagagaaaagaaaacgcccctgccagcaactgacaggggcgtatgtacccgagaggaattaacgcagacccagctggaagatcagcatttcagcttcgcaggcaaaagtgaaatcgatatccaggcgcacaccgtcagactcttcagtgaaagtcggggtgattttgcacggttcggattccacgctacgggctttttcagtcagcgccgccagcgtttgttctgcttctgcgcggtttgcaaacacacggctgtaagacgcggtgcagtcggagttgtccataatggtgccaacatccatacagcagcaaaccggggtttcatcagcactacatttactcatcgttgatttcctctgtatgtgcacccaaggtgccagataaacgttgtggatattttacgcttccggaaagtgctgctccagttgttaattctgcaaaatcggataagtgaccgaaatcacacttaaaaatgatctaaaacaaaattcacccgaatccatgagtgcgccacctcccaattttgccagctggatcgcgtttcttagatcatatctgaaaaaagatagaaacatacttgcaacattccagctggtccgacctatactctcgccactggtctgatttctaagatgtacctcagaccctacacttcgcgctcctgttacagcacgtaacatagtttgtataaaaataaatcattgaggttatggtcatgagccagaaaaccctgtttacaaagtctgctctcgcagtcgcagtggcacttatctccacccaggcctggtcggcaggctttcagttaaacgaattttcttcctctggcctgggccgggcttattcaggggaaggtgcaattgccgatgatgcaggtaacgttagccgtaaccccgcattgattaccatgtttgaccgcccgacattttctgcgggtgcggtttatattgatccggatgtagatattaccggacattctgatttaaccggtcagagtgcaaatgctaaaaatatcgcaccgacagcatgggtacctaacctgcactttgttgcgcctattaacgatcagtttggttggggagcgtcaataacttccaactatggcctggctacggaatttaccgacaactacgctgctggtatctatggcggtaaaaccgatctgcaaacaatcaaccttaaccttagcggggcttatcgccttaacaatagctggagttttggtcttggttttgatgcagtttatgccaaggcaaaaattgagcgttacgccggttcgctggggccattgttgtctcaacagttgattgcccagggtgtacccgcttcattaaccaatggtattaatactccggactctcaaattgctcatttgaaaggtgacgaatggggctttggctggaacgcgggtattctttatgaactggataaagataaccgttgggggctgacatatcgttcagaagttaaaatcgacttcgatggggattacaaaagctccattaacccaaatctgaacaatattttgggtaacatgggcttaccgtatggcacgatgggggcaacccaaaatggatccttaacgctgaacctacctgagatgtgggagatttctggttataaccgtgttgcaccgcagtgggcaattcactacagcatggcctataccagttggagccagttccaggaattgaaagcgaaaggcgatagtggtcagactctgttctataaagatgaaggattccgggacgcgtatcgtatcgcgttgggtacaacctactattatgataaaaactggaccttccgtaccggtatcgcttatgacgacagcccggttccggcagataaacgttctatttccattcctgaccaggatcgtttgtggttaagtgctgggttaacctacgcatttaatgaagatgcatccattgatgttggcgcatcttatatgcatggtcagaaagtgaaattcaccgaaggtgaaggagcggcagcttattccttcgagtctgaaggtaaagcctggctgttcggtactaactttaactacgcgttctgataacgcgttagcttaataagaaaaaaggtgagttttgcgactcaccttttttgtttgtttcttattcagaatcgatatcttttaaatcatcctgaatcgcttgcgcgttcggattttcctgcggtttgagttcaccgccattagcgatgaaatcatgacgctggaagtacgcttcacgcaccataatataaggatcggaggactgacgcagcagaccgtcggaatccaacaactgcgcacgagtttctatcccttcaagcgtccatttacccacagacatcggccaggtcagccaggaaagaaccgggtaaagactatccgccatatcaccaccgtcatcacgcagcgtgaagctaccgtagaacggtaactgaacgtacggcccataacccacaccataatgaccaagcgtactaccgaagcggtgaggttcagtccgttgcagtttcgggttcgccatccctgcaacatcaataaagccgcccattcccaaaatggtattcaggaaaaagcgggtaaagtggaccatcccctgataagggtcgccctgcaagaagtagttaaccatcaccgcaggttcttcaaggttgccggtaaagttgctcaaaccgttacgcgcaggttgcggaacataatcacgccaggcgacagcgaccggtcgaacaatatacgggtctaatacattgaagttgaagttgtacatagtgcggttaaacccttctaacgggtcagaacgcccttgctgatctgtaccggaactcgcacaccccaccagaagcgtagttcccagagcaagcgccgacaggcgaagcttcataaatgtctccctgtttttttatggcttatgcagtttgccatccatgacggaacgataccgtatccgcctgtttaggtgtgggcgattgtaacagcacgtcaactgatgtccagacgccctgatttgctgatttgatcatagcctggtaatcgccgccctgtaggctacttgattctatagaaacagaaaaaggcaaacgcggccttttctacattttcagagtaactcccgccagttgcgagcaaaaaagccgctacgctttagctatacgtgctaattcaagagaagagaccatggacaacgacaaaattgatcaacacagcgacgaaattgaagttgagagcgaagaaaaagagcgcggtaaaaaaatagaaatagatgaagaccgactcccctcccgggcgatggcaattcatgagcatatccgccaggatggtgaaaaagagctggaacgcgacgcaatggcgctactgtggtcagccattgcggcgggcctgtcgatgggcgcttcgctactggcaaaagggatatttcatgtcgaactggaaggcgtgccgggcagcttcttgctggagaatctcggttatacctttggttttattatcgtcataatggcccgccagcaattatttaccgaaaacaccgtaactgcggtactacccgtcatgcaaaaaccgacaatgagcaacgtcggcttacttatgcggttatggggcatcgtgctgctgggtaatattatcgggacaggtattgctgcgtgggcatttgaatatatgcctatcttcaatgaagaaactcgcgatgcatttgtcaaaatcggcatggatgtgatgaagaacacccccagcgagatgtttgccaacgcgatcatttccggctggctgatcgccactatggtatggatgtttcctgcagcgggtgcggcaaagattgtggtgattatattgatgacctggcttattgccctgggtgacaccacccacatcgttgtcggttctgttgaaatcctctatctggtgtttaacggcacgctgcactggagcgatttcatctggcccttcgcactacctactttagcggggaacatctgcggcggcacctttatcttcgcgttaatgagtcatgcacagattcgtaacgacatgagcaacaagcgcaaagtagaagcacgtcaaaaagcagaacgtgcggaaaacattaagaaaaatgataaaaacccggcataaatggcgagggtttaagcaatcgagcggctgtgtacttaccccgtagtccattagcgggtatactcatgccgcattgtcctcttagttaaatggatataacgagcccctcctaagggctaattgcaggttcgattcctgcaggggacaccattattgtgtttatccctaaaaccacgtaaaaaccgtaaattattaaattcgcactagcagtgccgaataaggcacaccaggaactcgtggtcttattcattatgaagtggtttttacctgttctcttaaccaagtaataaatgcctcaatttttggccactgcctgcccggtaatgtggtgatgtaataatgctgatggcatttcaccgtcatatcgccaaacggcgcgacgagctcaccactagcaagccttttttgtaccaggcgtttccttcccatcgccaccccaacatgattcatcgcggcgataacggctaaatcagaacgatcaaagccaattccagaagatgtcggcaaattagccgcataatgttgcgcccaactatgccattcatccgtaccggagtcgttgctccatgcctgtctgtcatggagcaacgtacagtgacgcaggttaattaccgtgttggttaaatcatgtctttgagcgtactccgggctgcaaactggcaagatttcttcatccatcagaaagtgatgagccaattgcgctgacggcgcatcatcaaagtagatcgccaaatcgattccggcacgttgcaaattgacattgtcattaccagtgagcacggtgagcgaaatagacggatatcggcgtgtaaagtcacctaatgcgggcaccaaccagcattgggcgatagagggccgggaatacagagttaacgttcccgataactcctgatttttgatatccagaatttcctgattcagggtatccagcgacgattttagcgcccaataaacacgtttcccctcgtgcgttaattccactttgcgatgggaacgaacaaacaactgaatacctaattcttcttccagctgattgatacggtgacttaccgcactggggctcagcgacaattcctctgccgccagggcgaaggactgatgcctggcagccacttcaaaagtatgcagttttgatagttgccagccgttaagcagtcgatttcttatttcacgaaggggttccataatcacctcatttttctcttaagtgtaaaaaaatagcggcaaaatttcagctgtaaggtgagctaaagtgaaccatatctcaattcaccttcatttttagatgtaaatcacccccttgatgcaatttagctcacgtgaaaggcaaattttatcgtttgtcagcctgcgttgtttttttgtccaatatcatcaggttaatcacaggggaaggtgagatatgcactctcaaatctgggttgtgagcacgctgcttatcagcatcgtgttaattgtactgaccatcgtgaagttcaaattccacccgtttctggcgctgttgctggccagcttcttcgtgggaacgatgatgggcatggggccactggatatggtaaatgctattgaaagtggaattggcggaacgctggggttcctcgctgcggttatcggccttggcacgatactgggaaaaatgatggaagtatccggggccgcagaaagaattggtctgacacttcaacgctgccggtggctttcagctgatgtcattatggtgctggttggcctgatttgcggcatcacgctgtttgttgaagtgggcgtcgtgctattgattcctctggctttttcaattgccaaaaaaaccaatacctcattgttaaagctggccattccgctgtgtaccgcattgatggcagtgcactgcgtggttcccccacatccggctgctttatatgttgccaataagctgggcgcagatatcggttcggtgatcgtctacggtttgctggttgggctgatggcatcactgatcggtggcccacttttccttaaatttctggggcaacgactgccctttaaacctgtacccacagagtttgccgatctcaaagttcgcgatgaaaaaacactaccgtcattaggcgcaacgttattcaccatactgctacccattgcgctgatgttggttaaaacgattgccgaattgaatatggcgcgtgagagtggtttgtataccttgcttgagtttattggcaaccctatcactgccatgtttatcgccgtatttgtcgcctattatgtgttgggtatacgtcagcatatgagcatggggacgatgctcacacatacggaaaatggtttcggttctattgctaatattttgctgattatcggggccggaggcgcattcaacgccattttaaaaagcagcagtctcgctgatacgctggcagttattctctccaatatgcatatgcacccgattcttctggcctggttggtggcacttattctgcatgctgcagtgggctccgctacggtggcaatgatgggggcaacggcaattgttgcacccatgctgccgctgtatcccgacatcagcccggaaattattgcgattgctatcggttccggtgcgattggctgcacgatcgttacggactcgcttttctggctggtgaagcaatattgcggcgctacgctcaatgaaacatttaaatactatacgacagcgacatttatcgcttcggtcgtcgctctggcgggcacattcctgctgtcatttatcatctaagcgcaaagagacgtactatggaaaacgctaaaatgaattcgctcatcgcccagtatccgttggtagaggatctggttgctcttaaagaaaccacctggtttaatcctggcacgacctcattggcagaaggtttaccttatgttggcctgaccgaacaggatgttcaggacgcccatgcgcgcctgtctcgttttgcgccgtatctggcaaaagcatttcctgaaacggctgccgcgggggggattattgaatcagaactggttgctattcctgctatgcaaaaacggctggaaaaggaatatcaacaaccgatcagcgggcaactgttactgaaaaaagatagccatttgcctatttccggctccataaaagcacgcggcgggatttatgaagtcctggcacatgcagaaaaactggctctggaagcggggttgctgacgcttgaagatgactacagcaaactgctttccccggagtttaaacagttctttagccaatacagtattgctgtgggatcaaccggaaatctggggttatcaattggtattatgagcgcccgcatcggctttaaagtaacggtgcatatgtctgctgatgcccgcgcctggaaaaaagcgaaactgcgcagtcatggcgttactgtcgtggaatacgagcaagattatggtgttgccgtcgaggaaggacgtaaagccgcgcagtctgacccgaactgtttctttattgatgacgagaattcccgcacgttgttccttgggtattccgtcgctggccagcgtcttaaagcgcaatttgcccagcaaggccgtatcgtcgatgctgataaccctctatttgtctatctgccgtgtggtgttggcggtggtcctggtggcgtcgcattcggacttaaactggcgtttggcgatcatgttcactgcttttttgccgaaccaacacactccccgtgtatgttattaggcgtccataccggattacacgatcagatttctgttcaggatattggcatcgacaaccttaccgctgccgatggccttgcggttggtcgcgcatcgggctttgtcgggcgggcgatggagcgtctgctggatggcttctatacccttagcgatcaaaccatgtatgacatgcttggctggttggcgcaggaagaaggcattcgtcttgaaccttcggcactggcgggtatggcggggcctcagcgcgtgtgcgcatcagtaagttatcaacagctgcacggtttcagcgccgaacaactgcgtaatgccactcatctggtgtgggcgacgggaggtggaatggtgccggaagaagagatgaatcaatatctggcaaaaggccgttaataacgtttcaacgcagcatcaccatcctttccctgggtgagcgatgctgccgatgacgcagacttaagattctgccgttttacctgctatagcctcctctttttccatcacccaacgcctttcgctgtaaacggcggtttcgcaaaccaaaccaaaaccgtaagtaagataaaagcaatagccgccatacggaaaatctcatttgcagaaatagaaagtgactgctgagttatttcattattaatttcattaagaactcctgaaagcgaaccatagtatttatccataatttgtgacgatgaattaaacacggggttaaattgatcgatggttgctgtcaactgactatggtgtaacgattcgcggcgtccccacagtgtcattgtcaacgacgtaccaactgatcctgacaaggtgcgaaaaaaattactcatactcgaggcattggcaaatttattatctggcaagcctgaaaacgaaatcgttgttaagggtaaaaagaaacaggcaacggcgaatccctgaaaaaactgtggcaaaatgatgcctgtaaaatcaatcgttggcataaatgtcacagaacgccagtaatagcaaaccgcatacatcaaaaaactaaatgtcaccaacaaccgcatatcaattttgttgccataacgtcctatcaaaggtgatattaatagcggcatgataccgatgggcgcataggcaagtccggcccatatcgcattataccccatcgtttcctggagtaactgcggcataagaactatcgctccagagtaaaataaatacgcgcatgtgatactcacaataccaatggtgaaattacgggacttaaacaaactgaggtcaagaatcggattctctgaggtcgactcccaaatgactaaagaaatcagagaaataactgatactactgttagtattattattgtactcgagttgaaccaatccagatcgcgccctttatcaagcataatttgcaagccaccaacaccgagcactaacagggtcagtcctggtagattcattttgaccggtgaagtctcagtttctcgtcctttaagtaaggttaagcataatgtcaggacgataatccccatagggacattgattaaaaatatccaaccccagctaaagttatcgcaaatatagccgcccaatatcggcccacatatcggagcgataatcacggtcattgaccataatgccagagcaaatgttcttttttctggtggataattccttaataataaactctgtgacagtggaattaacggccccgccattaacccctgaacgactctaaaaaatatcagcacatcaagattggtcgataaactacacattaatgaagacagcgaaaaaaaggttactgaaagtaaaaataaccttaattcgcctattctttgtgccagcctgccggtaacagggatcgcaatggcatttgctacgccaaacgaggtgataacccaggtgccttcgtctgttgatgctcccagaaagccagatattgtcggtattgcgacgttagaaatagtggaatccaacatttgcataaacgtcgctaatgacaatgcaatagtgacgcaccataacgtcccaccggttaatggtgcaggagttgatttagtgattgccattaaagttgtccattatgcgaaataatgttgctaatttctttttctatcggactggtatcgataactaaagccttactggtataagcaggcatggacgtcacggttgaagccagatcgggcatctcggcaatgtcttcattcttcgtatcaatagtagcagtcatcgataaaccaatgcgcaaagggtgttccatgagttcttttggatccagagaaacttcaaccggtacacgctgaacgattttgatccagttccctgtcgcattttgtgcaggtaataaggagaacgcattgccggttcccatattgatccctgtcacccgaccatgaaacacaacattttcaccataaagatcgctgataatattgaccgattgaccaatccgtacatccgtgagttgtgtttctttaaagttggcattaacccacatttgacgcgccggtacgacagccattagtgattgtccgggactcactgtttcgccgacctgaacacttctctgggcaatataaccggtaaccggactcttaatatccgtacgtttaagcgccaaccaggcttctttggttgcatctgcagcttcaatgacttgtggctgacggtttaatggtgtgttcattactaaagctttattcgctttataagcctggatagcagcattcaatgccgctttgctacttattaacgtatctttggtatgctccagcgcttcttttgaaataaccccttgcttcgctaaaggcacacgacggttataatcttctaaagattgttgatactgaatacgtgctgaagcgacttcggcactgtattgtttatcctgtaagtatagtttattcgtttgccgaacaatatttgccagattatttttagctttattgagtgcgatagtggcatcagttttatccagtgaaactaaaatgtcaccttgtcgaacgtagttcgtatctttatgattaacgacagtgacactgcctgagacttgtgcagaaattggatctgcatttcccgtgacataggcgtcatctgtactaatcatgtcttttaattccattgaccaataggcataggcacctgaaaacgcaataaataaaactaccgctaacaaagcaaaatactttcttctgtcagaatgttttttatttgaattaacctgttccactattatctctcatttcgcatagatgaaatttatgaattgaatgaaaagagtattcattcctcatatcaaacacagtgcatgttttgcacattatcccaggaacgttggagggctaatttaaatgaggtgcaaaaaaaacaacagaggactaaaccgcggcttttgcaatacaattcttacgcctgtaggattagtgagaaaacttatagtgctcatttgaaactataaatcatcggtatcatccctgattttattgttgacattttatttatgccgactatttatatggtatacttgtcgaattatcttaaaggaagcacaaattttcttatttttattgagaaaatgagatgataccttatgtctgtattactacagggagaagggaaatgcttcattgcaaagggaataatctatgaacgcaataattattgatgaccatcctcttgctatcgcagcaattcgtaatttattgatcaaaaacgatattgaaatcttagcagagttgactgaaggcggaagcgccgttcagcgggtggaaacacttaagcctgatatcgtcatcattgatgtcgatatccccggagttaacggtatccaggtgttagaaacgctgagaaagcgccaatatagcggaattattattattgtctccgctaaaaatgaccatttttacgggaaacattgtgctgatgctggcgctaatggtttcgtgagtaaaaaagaaggcatgaacaatatcattgcggctattgaagctgcaaaaaatggctactgctatttccccttctctctcaaccggtttgttggaagtttaacgtccgaccagcaaaaactcgactccttatcgaaacaagaaattagtgtcatgcggtatattcttgatggcaaggataataatgacattgctgaaaaaatgttcatcagcaacaaaactgtcagcacttataaaagtcgcttgatggaaaaattagaatgcaaatcactgatggatctttacacattcgcacaacgtaacaaaatcggctaaccacatgaagtttttaccctatatttttcttctctgttgtggtctttggtcgaccataagtttcgcagacggagattacatcgaatatcgtggcatcagtagtaacaaccgtgtcacacttgatccactacgtctgagcaacaaggaattacgttggctcgcgagcaaaaaaaatcttgtgattgcagtacacaagtcccaaacagctacgttgttgcataccgattcgcagcaacggattcgtggtattaatgctgattatttaaatcttttaaaaagagcgttaaatatcaaattaacactccgggaatacgcagatcatcaaaaagcaatggacgcgctggaagacggtgaagttgatatagtgttatcacatttagttgcttcgccgcctcttaatgatgacattgctgcaaccaatcctctgataattacctttccggcgctggtcactacccttcacgattcaatgcgaccgcttacctcatcaaaaccagtaaatattgctcgagtagcaaattatcccccagacgaggtaattcatcaatcatttccaaaagcaacaattatctcttttacaaatttatatcaggcattagcatccgtctcagccggacaaaatgattactttattggtagtaacatcattaccagcagtatgatttcccgttattttactcactccttaaatgtagtgaagtattataactcaccgcgtcaatataactttttattaaccagaaaagattcaatcgttcttaatgaagtactcaatcgatttgttgatgctttaacaaatgaagttcgctatgaagtatcacaaaattggcttgatacaggaaacctggcctttctgaacaaaccattagaactcactgaacatgaaaaacagtggattaagcagcatcccgatttaaaggtgctggaaaatccttactcgcccccctattctatgacagatgaaactggctcagttcggggcgtgatgggtgatattcttaatattattaccttgcaaacaggtttaaatttttctccgatcaccgtttcacacaatattcatgctgggacacagcttaaccccggtggatgggatatattgcccgccgctatttatagtgaagatcgagaaaataatgtttcatttgctgaagccttcataacaacgccttacgtttttgtcatgcaaaaagcgcctgacagtgaacaaacattaaaaaaaggaatgaaagttgccattccatattattatgagcttcattcgcaattaaaagagatgtatccggaggtagagtggataaaagtcgataacgccagcgctgcatttcacaaggtcaaggaaggtgaacttgatgctctggtcgcgacacagttaaattcgcgttacatgatcgaccattactatcctaatgaactttatcattttcttattcccggcgttcagaatgcatcactttcgtttgcttttcctcgcggagaaccggaacttaaggatattattaataaagcactgaatgcaattcccccaagcgaagttctgcgcctgaccgaaaaatggattaaaatgcccaatgtgaccattgacacatgggacctctatagcgagcaattttatattgttacgacattatccgttttattagttggcagtagccttttatggggattctacctgttacgctcagttcgtcgtcgtaaagttattcagggtgatttagaaaaccaaatatcattccggaaagcgctctcggattccttaccgaatccaacttatgttgtaaactggcaaggtaatgtcattagtcacaatagtgcatttgaacattatttcactgctgattactataaaaatgcaatgttaccattagaaaacagtgaatccccctttaaagatgttttttctaatacgcatgaagtcacagcagaaacgaaagaaaaccgaacaatatacacacaggtttttgaaattgataatggcatcgagaaaagatgcattaatcactggcataccttatgtaatctgccagcaagcgaacatgctgtttatatttgtggttggcaagatattaccgagacgcgtgatttaattcatgcactcgaagtagagagaaataaagcgatcaatgcaactgtcgcaaaaagccagtttctagcaacaatgagtcacgaaataagaacaccaataagctccattatgggcttcctggaacttctgtcgggttctggtcttagcaaggaacaacgggtggaggcgatttcacttgcctacgccaccggacaatcactcctcggcttaattggtgaaatccttgatgtcgacaaaattgaatcgggtaactatcaacttcaaccacaatgggtcgatatccctactttagtccagaacacttgtcactctttcggtgcgattgctgcaagcaaatcgatcgcattaagttgcagcagtacgcttcctgaacgctacctggttaagatcgaccctcaggcatttaagcaggtcttatctaatttactgagtaatgctctcaaatttactaccgagggggcagtaaaaattacgacctccctgggtcacattgatgacaaccacgctgttatcaaaatgacgattatggattctggaagtggattatcgcaggaagaacaacaacaactgtttaaacgctatagccaaacaagtgcaggtcgtcagcaaacaggttctggtttaggcttaatgatctgcaaagaattaattaaaaacatgcagggcgatttgtcattagaaagtcatccaggcataggaacgatatttacgatcacaatcccggtagaaattacccaacaagtggcggctgtcgaggcaaaagcagaacaacctataacactacctgaaaagttgagcatattaatcgcggatgatcatccgaccaacaggctattactcaaacgccagctaaatctattaggatatgatgttgatgaagccactgatggtgtacaagcgctacacaaagtcagtatgcaacattatgatctgcttattactgacgttaatatgccgaatatggatggttttgagttgactcgcaaactccgtgagcaaaattcttccttacccatctgggggcttacagccaacgcacaggctaacgaacgtgaaaaagggttaaattgcggcatgaacttatgtttgttcaaaccgttgaccctagatgtactgaaaacacatttaagtcagttacaccaggttgcgcatattgcacctcagtatcgccaccttgatatcgaggccctgaaaaataatacggcgaacgatctacaactgatgcaggagattctcatgactttccagcatgaaacacataaagatctacccactgcgtttcatgcactagaagctggcgacaacagaactttccatcagtgtattcatcgcatccacggtgcggctaacatcctgaatttgcaaaagttgattaatattagccatcagttagaaataacacctgtttcagatgacagtaagcctgaaattctccagctgctgaactctgttaaagaacacattgcagagctggaccaggagatagctgttttctgtcaacaaaatgactaaatagcggctcccacaatattcaaatgtgggagctatttaccagcacatctcacatttatgatgagaactcctggcgaatttgttccccatgctggtcgagcgttgccgctcccggcataacatgcggatccgcgcagccgctgatttttatcggattacctggcatcattattcccccggcttcaatcaacatatttctcgcctgagtttgtggcaaattaatagcctcagccacacttaataacggcgcgacgggcacaccaacttcatgtattttaactaaccaaacttcagctgcctgcgtttttaacgttcgctcaatatattgtttaagaatagcttggttttgtacgcgtaaaatattgctgctaaatcggggatcattaaccagttccgtaagctccagtgcctggcataacgcagaaaaaagcttgtcattaccacaacaaatagtaatcggcttatcctgagtatcgaaaacatcaaaaggtgccatgtagggatggcgatttcctaaacgttgtggtgacttcccagtcgcgatatatgccatcagtccatgctccagaaaactcagagtggcatcaaacatcgctatatcgacatgcgcacctctctggctcttttcgcggccataaagtgcactcactattccactgaataaataaacaccaccacagagatccgcaagagaggtaccaacgcgcactggcggagcatcagggtatcctgtttccatcattatcccgctcattgcctgaatgatggtatcgtaggcaggagcatcttttagcggaccggtatgtccgaaacctgacgatgaagcatatataaggcgcgggttgatttcttgtaacctttcccatgaaaacccgagtttttccattgtacctgggcgaaaattctcagctaatacatcagcttgtttaagcatatttataaatatacttttatcgtgatcattctttaaatcaagaaccacactctctttgccatgattaataaaactgtaatagagtgactgtccatccacatagggaccaaatgtgcgggtatcatcaccatgacccggcggctcaactttaattacccttgcgcccatattacaaagaagttgagttccgaaaggcccattaaggacatgcgtcatatcgataactaataagccttcaaacggccctttgcattcattatttgtcatttgcttatgccttgaaaaaagccgaaggtgaaaagacacttcggcatttatgtaaaatcaataaaatgattaattatgaaaccagtcgactgacataaatccacaaaggagccgtgacgacaaaacccagtacgctcacagccaatgacgctgtaccagtgcgggtgtagacattaaaccggctggcaataatgattccggagaatgccggcggtaatgcgcctgccagtaccatcatctgcaaatgttcgctattcaaatgacatgccatacctacgagaagcagcgccagtggcatcagaatcagcttcaggaaagtgttataagcaatttcggcactgaactcgaatttatgtgcagccagagtcaaccccgcagcgaataccgctacccctgagttagccttcgcaatcagattaaaggttgggtcccatgctgccggaatttttaccccaaccagcaccaggatcgttgccagaacaggtgcccatactactggctcctttgccgcagaaattaatgcgctcagattactattcttcttaccatccgctcctgaggaaggattcagcaaatacagaccaataggaatagtaattgcgttaacaataatagaaataattgctaccactaaacctgttgatacggaatcaccataaataggatcgagaactgcaaaccccaggaatccaatggtaggtgaacctgcaattaatgcacatactgctgcttctgcatgggtacgtttaaaaaatttgtagcaaccgaaccaggagaaaaagaaacacccgacaataaccacaagtgatacaagggtcaggcgagtgtccgcaaaaatcatttccctgtttgccctggtaatagaaacaaatagagccgcaggaagagcgtagtttaataccagtttattaaatgcccgagcttgatcctctgaaaaagtttctcgtctgccgctaaaataacccaacagcatgattacgataataggcaataaatcgccaataaaaaatgttagcataatagtatttccgataagggtccccttaccatcgcataataagttggcaagaggagacgatgtcagtatttaattaccagcgacttgttttgggttaagtttggtaatatggccactttcagttcctgctgctgggtcgatgaccacattaataatggtcggtttgcgcgactgaattccggtggttaaagcatgacgaagttcatctgtcgtggtgacgttatagccaacgccacgaaacgcatccattaatttgtcataccttgcatggtgcaacagatccgttggcgatggtgcaccagcgccgctgagatcaacaccgtcacctctgtagatgccgccattattaaaaataacgatcgtcaccggcaggttatatcgacaaatcgtttcaatctccatcccactgaaaccaaaagcactatcaccttcaatggcgacaaccggagaaccagaggtcacgctagcaccgatggcatagcccataccgatgcccatgacaccccaggtgccacaatccagacgacgacgtggtttatacatatcaataatatttcgtgcattatccagggtatttgccccttcattaactaaataaatatcctggttctcgcgcaaaacatcgcgcacagcactcaatgcattaaagtaatttaatggttgggtatctgtacttaacttttcatgcattttttgtgcattttgctgcttgtggatatttaaaatatcgcgccacaccagtggagtcgtgaatgtgttttgtttcaattctgccaacataccttgcatactggatgcaatatcgccaacgactggcacagcaatggggcggttgctgtcaatttcctgcggttcaatatccagttgaataaactgtgtttctgccgcccatccttttttaccgtgtgccagtaaccaattcagtcgtgcaccaacaagcatgacaacgtcagcatttgccagggcaaacgaacgcgcagctgccgcagagagtggatgcgtatcttcgaggatccctttcgccatagacattggcaggaatggaatctgggcactttcaataaattcacgaagctgttcatcagattgtgaatacgccgcgcctttgccaaggataattaatggtcgttcagcttttgctaaaagcgaaattgcgctagtgactgacttcgggcatggcaataatgctggcgacggattttcaactttaacaatcgtggttaacgcttcgtctttttccatcgtcgcggccaggacatttgctggcaaatcaagataaacaccgccaggacgacccgatactgagacccggatagcgcgtgccaatgcaatgccaagatcctgcggctgattaacgcgaaatgctgctttggcatacggttttgccgcattcatttggtccagctcttcataatcaccttgctggagatcgacgatcgcgcggtcgctggaaccgctaatcatgatcatcggaaaaccatttaccgttgcattggccaatgcggtcaaaccattgaggaatcctggcgcagacactgtcaggcagatccctggtttttgggtaagaaaaccgcttgctgcagcggcatagcctgccgactgctcatgacgaaaaccaatataacgaatgccttccgcctgggcatggcgcgccatatccgtcacaggaatacctacaacaccataaatagtgtcaatattattctgttttaatgcttcaacgatgatatgcataccatctgtcatttgaagttgatctgacatgattaataacctcgaaatttttataaattgggagccagaagcccccgttaatatcagatggcgtggttttgcttcattgcagcaatttcatcgtcgctataacccagctcctgcaatacagcagcggtatgttcacctaatagcggcgcagctttaatatctggcgtaaaggcagagaatttcattggacaaccaactgtcagatattttccacgcaacggttgttccacttcgacaacactgccactttggcgcaaagagggatcaagtgaaatttctttcatacttaaaaccggtgcacaaggaatatcaaactgagtcaaataggccacagcttcatgtttatcaatagtgacagtgtatttttcgatttcagcaaaaatatcgaaaatatgtggctgtcgggcatgggctgtactgtatgccggatcggtaatccattctggtttgccgatggctttacaggtgttttcccagttttgctcctgaatagtgaaataaatataggcgttaggatcggtttcccagcctttacatttcaggatccagccaggctgaccgcccccacccgcattaccaccgcggggaactgcatcaccaaatgtgccattcggatactgcgggtattcttccagataacccaatttatcgagacgctgctggtcgcgtaatttcacgcggcaaaggttcaacacggcatcctgcattgacatggtgactcgttgcccacgccccgttttttcgcgatgcagcaaagcagcaagtaaaccgatcagcaaatgcattccggtgttgctgtcacccaacgctgcagcgcttaccagcggcggaccgtcccaaaaacctgtagtagatgccgcgccacccgctgcctgagcaacgttttcataggcttttacattcacataaggcgaacactcatcaaaccctttgatcgaaccaaaaatcagacgtggattgatttcttgaatatgctcccaggtgaagcccatatgatcaatggcccctggatgaaagttctcgactaagatatcagcttcgcggatcagcttttccattacctctttgccttccgctgttttggtatttaattcaatagaacgtttgttactgttaagcatggtgaagtaaagcgcatcgatatcaggaatatctcgcagctggtggcgcgttacgtcaccaaagccgggacgttcaattttaatgacgtcagcgccaaaccaggccagcatttgagtacaagatgggccagattgcacaccggtgaaatcgagaactttaattccttgaagtggagttgacatagcaatacctattagttaattaaatatgtgttaatttagcgtttatttaaggcataacgcctctataaataatctgcaaaatatcgtcgtagctgcactcgatatttttaaattcctgtatcaagtgctgaaaatcatttcatcgctacttccaattcctttctgcatggtaagtagtgaggacgaaaagaagaatataataaatattggttcgcggtaatcagagagagccgcgacatttgtgatgttattcttacaactgtaagaagtgtcagtgatttacaattaaggttatgattacactatttaaagcgtaccataaaatataacataataaatgatttgtgataatatgggattattgcggtttactttgaggaagataaaatgcgagtttatagaaccgcgagcgccaaataattttatgaccacaacctgtcgtattgtggtcataaaaaattgtcgactggagggagttaaatcctttacctcaatatattgcctgtcaggtttagttcacaaacagtgcttcgctatcaacgatgattccatcttccgcacctttaagcgccaggtttgcctcgtagtattgctttttatcaagcagtttctgcgcatcagcaagtgcattacgagtctgtttaagcggcatcaaatattggttttccattacaccaacaccggccaggcgaagctcttccattgccccctttttatcccctttcgccattttttcgttggcaatttttatcgcggcttctttttcgggtgtcgctacataactctcagaaattccgacagatgcattaatgacaatatattggtcatcattgacgttggtctttttacctggcttagcgaactttgcccattcggtactatcatctgacagcaaagcggaagcttcattggtcagttcttttgccttttccggatcgccatgaaacagagccaggcgcgctacctgcacgtcacgcatcgcatataaaccttgttcagagatacgctctgctgctgccgttttctgggtttgcttaacttgctgagtttgctgttgtgccgctaccggtgcattatcagcagcccatacagttgaagatgccagaattgctgtgaccatcgtagccataattaaacgtttcatacttacctcattctttaacagttttagaaaacgccgccatcatattgggtgagcatgaaatgagaaatcagagagcaacggacattttgaaagggttatcttacaactgtagttattatcgcaaagccgcttttagtcttacagttgtaggaatctgcttcctgtcgcagagaactattcttatataccacaaagatatgtcatttattatgtcgatgtaaatactgattaattaaatataaatacagccataacatcgtaggttttcagtgaaccattttcaggatattttctatgaaagtaaacttaatgctttttagcttatttttatttgtctctattatggcatgcaatgtttttgcattttctatttctggtggtggtagtgaggcgagctataaagagacagaaaaaacgtcagtgatgacgacaacgcattctacaaaacttcagccatcacaggcgattttgtttaagatgagagaagatgcaccaccattaaacctcacagaagacatcacgtctacttatccgacaaaggcgaattatctcattcatcctttgcgatagcgtctgtcacctggcaggtgaacaatcatgtctgatgctgatgtgaacacctgcccaaatgagccatcctgacccactatcgcctgccataccccaccataaagcgaatcatcaagccacaaaccggggcaagaaacataaatatccccgtcaccagttcattaccgccagttaaccacatggtgaagtaataaatgagtgcagcgaggatcaccatgccgaagaaagaagagatcgccgataccatgttcagtacctgaccgatgtatccgcttacgcagacaatacacagggcgagaaacatccataaataaatcatagctcaacctcctgccgcgctaaaaaacctgtaacttcagtcactttaatagtaagacaatccttaacctctggcaatttttgctaagcatcaatcaaaacagcatgttaaatgcaagactgttacgtacggaaaaatatttactttgcacgattaataatcagtagctgaaagcagtcagcgagtgataaagtacagataccgcattcatgctcctcgtggttatgtcctgactagtctttacactctttacaggaaccattgtcgtacatgatggcctaatcaattgagtgtaccgctgtcgacatggaatcttctgcgatacaacaattcgtatctacagaaggtaactatgtttccaaaatgcaaattttcccgcgagtttctgcatcctcgctactggctcacgtggtttgggcttggtgtactctggctttgggtacagcttccttatcctgttctctgctttctcggcacgcgtatcggcacaatggcgcgaccattcctgaaacgtcgtgaatctatcgcccgtaaaaacctggaactttgtttcccgcagcattctgcgaaagagcgcgagaagatgattgccgaaaactttcgttcactcggcatggcgctggtagaaaccggcatggcgtggttctggcccgacagtcgcgtacgtaaatggtttgatgtggaagggctggataaccttaaacgcgcacaaatgcaaaatcgcggcgtaatggttgtcggcgtccattttatgtcgctggaactgggcggtcgggtgatgggactttgccaaccaatgatggccacctatcgcccgcataataatcagctgatggaatgggtgcagacccgtggtcgcatgcgctctaacaaagcgatgatcggcagaaataatctgcgcggcattgtcagtgcactgaagaaaggtgaagcggtatggtttgctcccgatcaggattatggtcgtaaaggcagctccttcgcgccgttctttgcggtggaaaatgtcgccacaaccaatggcacctatgtcctctctcgtctctctggcgcagccatgttgaccgtaacgatggtaagaaaagcggattacagcggatatcgtttgtacatcaccccagagatggaaggctacccgacagatgaaaatcaagccgctgcctatatgaacaagattatcgagaaagagatcatgcgcgcaccggagcagtacctctggatccaccgtcgctttaaaacgcgcccggtgggtgaatcgtcgttatacatttaacaaactgctctcactctttccctcctcaaatcagccataataacctcatggtttttatggcttttttcttaagtttttttccttcgctgaatatctaattattaccgtcagaaattaaactgtcgccgatatgagacacctgtaagttactaaaagtaaataagaaaatgcctcttgtctcgtttcatttttaggcgtacattagcgccgtctcgagcagtttagctcagaattctggggtgatgcccacggtaaaatacaggacgtttaaggtcgttttgcccggtgtcaactcactgtatcaggtgtaatgaagtcattcaggcgtaacagtaattacgcggagagatgtaaagtgaaatatttctttatgggcatttcttttatggtcatcgtttgggccggtacttttgccctgatgatctaaaagcaaactgtgcaatgaaaaacaggagccatctggctcctgtttgcatttctgacgatggtgtttattccgcgttttcgtgaatatgtttgctgctggcaggtagtaaaccgtcggcacggaacatcgctttaatcccacgaatcgcctgacgaatacggtcgcggttttcaatcagtgcaaagcgcacatgcgtatcgccgtagtcgccaaagccaatccctggagagacacagaccttcgcttcgttaagcaatttcttggcaaattccagcgagcccatggcagcatacggttccgggattttcgcccagacatacatcgaagccttcggcatttcgaccatccagcccgcttcatgcagccctttcaccagcacatcacggcggcgtttgtactgttcggcaatatcgcgcacgcactgttgatcgccctccagcgccgcaatagccgccacctgcaacggcgtaaaggtgccgtaatcgtgatagcttttaatacgtgccaacgcgctgaccagcgttttgttaccgaccataaagccgatacgccagcccgccatgttgtagcttttcgacagcgtaaagaactcgaccgccatgtcgcgtgcacctggcacctgcatgattgacggcgctttccagccatcgtagacgatatcggcataggccaggtcgtggaccaccagcacatcgtagcgtttcgccagcgccacaaccttctcaaagaattccagttccacgcattgcgcggttgggtttgacgggaagccgaggatcatcatcttcggtttcggataactttcacgaatggcgcgctccagttcattgaagaaatcgacaccttccaccagcggcactgagcgtacctgcgccccggcaatcaccgcgccgtaaatatgaatggggtagcttggattcggcaccagcactgtgtcaccatgatccagcgtcgccagcatcagatgcgccaggccctctttcgaaccaatagtgacgatggcttctgattccgggtcgatttcaacgtcgtagcgatcctgataccagcgggaaatggcgcgacgtaaccgcggaatgccgcgtgaagtggaataaccatgcgtgtccgggcgctgggccaccgtacataatttttcgacgatatgcggcggagtcgcaccgtccgggttacccatactgaaatcgataatatcttcgccgcgccgacgcgcagccattttcagttcagcggtaatgttaaaaacgtagggcgggagacgatcaatgcgcgtaaagcgacgttcagggcgagtgtcagccataatttcctcagattaacgttagcgcccggaccgtccgagcgacgctgccacgatggtggctgttttgaaaatagcctgattaatttctgtctgtccagcgttttagaacatttttatcaatggctttaaatgaggaactccacttcaaaaacaggaaatttatctacgctaacaagaaaattaccactcattttattaacattataatttcaataaatttaccaaccagatgtgcattatcaagagatgcattgctaatacaccatttatctttcaatccccttttaaaattgtggtttttcctcaaaaacggcctgctggtcatcagccttcaggttacctatcatagaggtttaatccttattcagagtcacccgtgcacgaaatattcaacatgctgctggcggtcttcgatcgggcagcgttaatgcttatctgcctgttttttctcatccgtatccgcctgtttcgcgaactgttgcacaagtcggcacactcaccgaaagagctgctcgccgttaccgccattttctcgctgttcgccctgttcagcacctggtccggcgttcccgtagaaggctcgctggtgaacgtacgtattatcgcggtgatgtcaggcggaattctgtttggcccgtgggtgggcatcattaccggcgtgattgcgggtattcaccgttatttaattgacatcggcggcgtgacggcgatcccctgctttatcaccagcattctggcgggttgtatatcgggctggatcaacctgaaaatccccaaagcacagcgctggcgcgtcggtattctcggcggcatgttgtgtgaaacgttgaccatgattctggtgattgtctgggcaccaactaccgcattggggatcgatatcgtctctaaaatcgggattccaatgatcctcggtagcgtctgtatcggctttattgtgctgctggtgcaaagcgttgagggcgaaaaagaggccagcgccgcgcggcaggccaagctggcgctggatatcgccaacaaaacgctaccgctgtttcgccatgtcaatagcgagtcattacgcaaagtttgtgaaattattcgcgatgatattcacgccgatgcggtggcgatgactaatactgatcatgtgctggcctatgtcggcgtgggtgaacacaactatcagaatggcgatgacttcattagcccgactacccgacaggcgatgaattacggaaaaatcatcattaaaaacaatgatgaagcccaccgcacaccagagattcattccatgctggtgatcccattgtgggagaaaggcgttgtgaccggaacgctgaaaatttactactgccacgcgcatcagataacctcgtcattacaggaaatggcggtcggtctgtcacaaatcatctccacgcaactggaggtttcgcgcgctgagcagctgcgtgaaatggcaaataaggcagagcttcgcgccctgcaaagcaaaattaatccccattttctgtttaacgctttgaacgctatttcatcgtcaatccgtctgaatccggatactgctcgccagctgatctttaatttgtcgcgctatctgcgctataacattgaattaaaagacgatgagcaaatcgatatcaaaaaagagctgtatcaaattaaagactatattgccattgagcaggcccgctttggcgacaagctgacggttatctatgatattgatgaagaggtgaattgctgcattcccagcctgctgatccagccgttggtggaaaacgccattgtccacggtatccagccttgcaaaggtaaaggcgttgtcaccatcagcgttgctgagtgcggtaatcgggtacgcattgcggtgcgagataccgggcacggcatcgatccaaaggtgattgagcgggtcgaagcgaatgaaatgccgggcaataaaattggcctgctgaatgtccatcatcgcgtgaagttattgtatggcgaggggctgcatatccgccgcctagaaccggggacggaaattgcgttttacattcctaaccaacgcaccccagtcgcctcacaggctacgttattgctttgagccggagtgatattgtgaaagtcatcattgttgaagacgaattcctggcacaacaggaactgagctggctaattaaagagcacagccagatggagattgtcggcacctttgacgacggtctggacgtgttgaaattttcgcagcataaccgcgtcgacgccatttttctggatatcaatattccgtcgctggacggtgtgttgctggcgcaaaacatcagccagttcgcccataaaccgtttattgtgttcatcaccgcgtggaaagaacatgcggtggaagcatttgaactggaagcgtttgactacattctcaaaccgtatcaggaatcacgcattaccgggatgctgcaaaaactggaagcagcctggcaacaacagcagaccagcagtacgacgcctgccgcgacggtaacgcgtgagaatgacaccattaatctggtgaaagatgagcgaatcatcgtcacgccaattaacgatatctattacgccgaagcgcacgagaaaatgacctttgtctatacgcggcgtgaatcctacgtaatgccgatgaacattaccgagttttgcagcaagctgccgccgtcgcattttttccgctgccatcgctcattttgtgtcaatctgaacaaaatacgcgaaatcgaaccgtggtttaataacacctacattctgcggctgaaagatctggattttgaagtgccggtcagccgtagcaaagttaaagaattccgccagttaatgcatctgtaatcgggaactttcatgaaagcaccaggcttgcccgccgatcaacaatttttcgccgatctgttcagcggcctggtgcttaacccgcaactccttgggcgcgtctggtttgccagccagcccgcctcattgccagtgggcagtttatgtattgattttccccgtctggatatcgtgctacgcggcgaatacggcaatctgctggaagcaaagcagcaacgtatggtggaaggagaaatgctgtttattccggcacgcgcggctaatttaccggtcaacaacaaaccggtgatgctgttaagcctggtgttcgcaccgacctggcttgggttatcgttttacgatagccgcaccacgtcgttgttacatcctgctcgccagatccagcttcccagcctgcaacgcggtgaaggtgaagcgatgcttaccgccctcacccatcttagccgttcgccactggagcagaatatcattcagccgctggtgttaagtttgctgcatctttgccgtaacgtggtgaatatgccgccgggcaattcgcaaccgcgcggcgattttctctatcacagcatttgtaactggattcaggataattatgcccagccgctcacccgcgagagcgtggcgcagttttttaatatcacgccaaatcatctgtcaaaactgtttgctcagcatggaacaatgcgttttatcgaatatgtgcgttgggtacgaatggcaaaagcgaggatgattttgcaaaaatatcatctgtcgattcatgaagtggcgcagcgttgcgggtttccggatagcgactatttttgtcgcgttttccggcgtcagtttggtctgacgccgggagagtatagcgcacgttttcagggctaacttcagaaggttaattccgtttccagcagcgtcagaatactttgtgcatcttgcgcggcaaacagcgactggcggaagtttttattcaccagtttacgcgccagctgcgagaagactttcacatgattcatcccttcgttagcgcccagcgtcagcatgatcaccagttcgacttcgcccatttctgactgccagtcaaccggtttcaccaaccgggcaatgctgatactggaatgacggatccactgtgatttggtgtgcgggatcgccacgccaaaaccaacgccagtagtaacaatctcttcccgctgccagacatcttcttccagctcgaacggatgttcagtacgcccgttaacaccgaggttaccgcacaggaactggatcgcctgctctttattactaaaggactgatcaacaaagatattctctagtgccagcagtgggcgaacgtcttcttccggcgtaaacgcggtaagtaacgcttcaatttcctgcgcgctgcggcactcgcacgcctgacgcgccagttcccgacacgcctcgctatccagttgacgaagctggcttttcactgccggaatacgcgggctactcatgcttagctcatccaggcccagccctagcagtagcggcagataacgactttcaccgcccagttcaccgcaaatacctacccatttgccgcgctgatgcgcagcggtaacaatctgctgcaacatgcgcaggaacgatggcgtaatcgggttatacagcggcgatacgcgcgggttattacgatcgactgcatacagatactgggtcatatcgttagaaccgatactgaagaaatcgacctcatcgcagaagtggtcgatgatgtagcacaccgacggcacttccaccatgatacccagcgtaatcgtctctgcatgacgcaggccatcgcgcttaagctcaacgatcgctttttggagctcacccttcacccataagatctgatcgagactgtggaccattgggatcatcaactgggcgttgccgaaactggcagcgcgcaaaatcgcccgcaattgagtgcggaacaggccagcaaattccgggtaaatacgtaccgcgcgatagccgaggaacgggttctcttcctggggaatgttgaggtaaggaatgcttttatcgccgccgatgtccatcgtgcggaagataatcggcttgtcgcccgccgccagtagcacctgctggtacgcttcaaactgttcctgctcgtccggcgcgctgtcgcgatccatatagagcatttcggtacgaaacagcccaacgccttccgcgccgttagcaaacgcgcctggggcttccagagcggtgccaatattcgccgcaatatcaatacgtttgttatcacgggaataggccagctgcgcggcagcttgcgcctgttgtttttggcgtttatccgccagcgtctgcgcgacctgataataaccgctcaccgcgtcattcgggttaatcgccagcacgccgcactgggcgtcaagcactgcaggttgcccggcataacgggcaatcgcatccagcggcagtccgctcagtaccgggatcgccgaagcgcgggccaggatcagggtatgcgaggtgcgcccggttttctccagaatcatgcccgcaagattttttaaatcgaggctcaaaaactggcttggggttaaatcttcagccaccagaatagtcggtttttcaagcaccagattattgcgcggttttagttccggccaggtgatatgcagcaactgttcgctgatatcgcgaatgtcgctgacccgctcgcgcagataatcgctggcagaagcagaaagtttggcacaaatctgctccatattgctgatgatcgccgcccccagcccctgatgctgttctgccatcaggtgacggatattgcctgcaaattcatcatcctgaatcagcgacaaatgggcgctgaggatagttttactttcgccgtcacgctcacgcaattgctggttcagttgctcggcaagcgttgccagactgtgctccagcagggtggaatcttgcgcactggccggtattgcccgataactgtcgaggctgtcgctctgtaacagggtcagtgtacccacgccaacgccgcttgccagcacgttgccgtacagtaaatccgggttcaggcggcttaatgaacgcggcagcggatgcgccgtcagttctgcctgcgtcggctggacgctatcgctgtcgataaagcgcatctggatatactcttccagcactcgccgcgcctgctcttcatcgctaccgctaatgttcaggctgcaactgtcattaaataaagtgccagtgccaatcagcgccagcgagcttttcgcatcggcctttgcgttctggcgatggttaataaaagtgatttcgctttgccactggctgcactgctctttaagttcccacgccggacgagcatgtagaccgttaggcaaaggacagagaaattgaatcgttaacataaccgctccgggttaatcaggagatcatctgaaatccgtcagttgaacaaccgtctcacgcgtaagacgttgaataagggcagataaaagttgctccatctgcaaaatgtcacggcagtcggcaatcgatgcggcgcaatgtccgtggcgggttgcaggccccatcaccactgtgggtacgccagtgccggttaagtgcaccgccccaccgtccgtgccgccattgctgaacatatctgactgcaacggtacgccaatttctgccgccacggtttcgatccaggcggtaagttttggcggcgcaatcagtgacttgtcgcttaacaccagcatcggcccgttaccaatctggcgatggttagctgcgccataatcaaagtttttcgcccagcaggcggtatcaagcacaatggcgacatccggcgacaccgcgcgggtggcagtttgcccgccgcgtaatcccacctcttcgctggaacttgccaccagccacacttccgcaggcagttcggcgtcgtgcagctcacgcagtaacgtcaccagcagatagcaaccgaggcggtcatcaaaggctttccccatcacccgctggtgagggagaacctgaaaagtggtatcgaaggtgacgcgatcgcctggacgaattcctgcctgcatcacttcgtcacaggagcgcgcgccaatgtccacgcgcatggcgctgacgtcattcccctgccggtcgccgtcaagcaggcctggaattttgcactcttcacgggtagtgatacgcaccgactgaagctggcgggcagccatgcgtacattgccaaccggcaacacatcgatcgccccttcgcgggagatgctgcgcaccataaatcccacttcgtccatatgcgcacagatcatcaccttcggacctgtcgactcattgagtcggatcagcaccgatcccagcccatcaaatcgcacttctttttgcaggcgatccgcttcttcccgtaggatctgccgtacttcctgttctgaggaggcgatcgcatctgcctcgctcaacgcttttaagagcgataaatccattatgcctctcccgtgagcaacactgttttcggcatggcgtagagcacttctgcgccttgcggggtgaccagcacgacatcttcgatgcgcacgcccccttgccctggcaaataaatccctggctccacggtcagtaacatacctggctgtagcgtcgtggtgtcccgcggtgaaaaacgcggctcttcatggacttcaataccgatagcatgaccggtgttatggccgaaaaacttgccataaccggcctcggtaatcacgcggcgcgcggcatcgtcaacctgctggcagcgcacgccggggcgaattacagagattgccgcgagctgtgcctgcaggactatctgatagacgttaaacagcgggtgagattcggcgctcaccccttcgccattcaccagcaaggtgcgcgtcatatcagagcagtagccctgatagagcgcaccgaaatcgagagtgacaaactcgcccgctgtaacaatcttgtcgctggctttgccgtgcggcagcgccccacgccagccgctggcgacaatggtgtcaaaagaggctttttctgcgccctgccggcgcataaaccactccagttcagcggctatctcgcattcgctcattcccgcctgaataaagcggcgaatatgctctgcgccacgatcggcaatcccgcaggcaaggcggattttctccacctcttctggcgttttgatttgccgcagcacatccggcgtggcgctcaccagtttcgcattgagttcggactgccagcggtgcgcggtttcccaactcacctgctggccttcaaaaccgagtgtttgcaactgctcatcggcaatgatttgtctgacgatggtggcaagcgtgtgcatcgcgtcgagcaaatgcagctggtaaccttgcgtgcgggcttctacatccgcgtaatagcgcgaatccaccagaatgtgcgcactttcacggctaatcaccacataacctgatccggtggagatccccagatgcggctgtttgttctgccgtgaggagagaagcaccgcatccagttgttgtgccttaagccagtcacgcagcgaagcgagtaatgtcatctggatttttccttcttacaggctatcgattaacaatttgcctttacggaacatcatcagacgcaggaacaccaccatcagcgcagttatgactgcccccagcgcgatccccgccatgtagacgccgaggttagtgaccagcggccatgcccagatagcggactccggaaaccattgcactgcgcccagccagacagcggcggttgagccgacaatcgcgccgaccatatacgacggaatggcggtgatagggctttccagtgcaaacggaatcgcaccctcactgatccccataaacgccaggaacatcgcggttttaccctgcggataaagctgggcgttgaacaagcgtttgccagttaagcgacgatcgataatggtcgccagacccagaccaatcggcggaataacgatagcgatagaacgtgcagtgaccggtaatacgtggtcagtggtaaagctgaaggcaacgaaacctgccgctttgttgatcgggccaccaaggtcgattgctgtcgccgcggcgatccccattgcgtacatcagcgcgcccttctcacctgcagcggtcagcacggtacggataccgccgttgatccagccaccaaagggggtgatgacgtagtacatcgccagcatgacaaaaatggcggaaagaatcggtagcaaaaatgtggttttgaacgctaacaggaaatccggtaactggattttctggttcatccacttcacgaggtaaccggcaacgatagaaataatcagcgcaccaatgaaggtggacggcaccggcgaagaggtcgcccattgcatcgtgctgggatcgaagttcagcagttgcgtcggctgggtagacatcaagccgccgataaatccagccgggaacgccagtttgccaccgatagagttcgccacaaaagcagcaaacatcggaatggcaaaaccaaacaacacaccgccgaaggactgcgacagccaggcaaatttcagtaaggagaggtcgaaaccggagaatttcccgctattaagagcatccatgatgccgatatcagcaggaattttaagccagctataagcaatcagctgactgaaagcgaggatcacaccgcccataattaaggtcggcaccatgcgtgaaatccctgacatcacatgctgcgggagttcaccccagaagctggatttagaggcctgcggattcttaactgccgctgccgcaccggatgcgccatgcacaacggttgcactgcgttttttaatggccataacaattatccctgtcgaatattactgttgttcagaggcaatcatctcttcgatttctttgatgattcccgcagcgtttttaattgcgtcctgcaaagtgatttcataaacgtcgcgtgattcgaaacgttcgttatcttccggggtaactgccacggagtggatgatgatggtcgcttcggcgatatcctgcgccgtcaggcgattctggataccgtccgcgccctgggtttcaattttcacttcataaccggcttctaccgccgcttcttccagcgcctgagcggccataaaagtgtgagccaggcccattgggcaggcacataaggcaatcagtttcttactcatcgttaattcctcgttcagtgatagttgacgagtgaaattatgaacgtgcaaaacaaatcgccgttaccagacaaataatgcatttactggagaattaatcccgctgtacggaagtgtgacgcaggtcggccttgtgagggggacacaaagaaaatttaattaactgtatgatttaaaagattatcgggagagttacctcccgatataacaggaaggatttagagaatgtgacctaaggtctggcgtaaatgtgcaccggaaccgagaagacccggattgtcatggacgatgagatacaccggaatatcatggacatattctttaaagcgccctttatcttcaaatgcggcgcggaaaccagaggctttgaagaactcaaggaagcgcggcacgataccacccgcaataaacacgccgccaaatgtcccgagattgagcgccagattgccgccaaaacggcccataatgacgcaaaacagcgacaacgcgcggcggcaatcggtgcagctgtcagccagcgcgcgttcggtaatatcttttggcttgagattttctggcaggcggttgtcggctttaacaattgcgcgatacaaattcaccagtccagggccagaaagcacgcgttccgccgaaacatgaccaatttccgcacgcaatatttcgaggataatgccctcttcttcactattcggcgcaaaatcaacgtgaccgccttctcctggcaagcttacccaacgcttatcgacatggaccagatgcgcaaccccaagccctgttccggcaccgtaaaccgcaataggcttaccttctaccggttctgcgccaccaaactgaatcagatgctcttttttcagcatcgggatcgccatcgatacagcagtaaaatcgttaataatttccagatggctaaaaccgagattctttttcatttcggcaattgagaacgcccaggtatggttggtcattgccacccagtcaccggtaattgggcaagcgatggcaatacagccgtctttcacctcgaccttatgttcttcaagataaacgcgaataaccgcttcgaggctggggtaatcaagccctgaataggtcttagcctgcgagatttcaccactggcaatatcacacagagcaagacgtgcgttggtgccgcccacatcaccgactaatgcatactttgtcattcttcaactgctccgctaaagtcaaaataattctttctcacactgtaaatacctgggggcataacaacaacgccggaaaggcaggctccctgtaaatatcgatctgggtcacacaattactttatcgtttcagcaccaattgcagcgatgcctttttgcaagctgggcaaactaagtatctgaccccgcataaggaatagaacatgctccatccgcgagccagaaccatgttgttattatcgctccccgccgtggcaattgggattgcgtccagtcttattctgattatggtgatgaaaatcgcctcggtattacagaatttgctctggcaacgactgccgggaactctggggatagcccaggattcacctctctggatcatcggtgtattaacgctaacgggtattgcggtggggttggttatccgtttcagccagggtcatgccggaccagaccccgcctgtgaaccgcttatcggcgcaccggttccgccctctgcgctaccaggacttatcgtagcattaattctcggtcttgctggcggcgtcagcctggggccggaacatccgatcatgaccgtcaatatcgcccttgccgtcgccattggcgctcgtctgttaccgcgcgtcaaccgaatggagtggactattttagcctctgccggaactatcggcgcgctgtttggcacacctgttgcggcggcattgatattttcgcaaaccttaaatggcagtaatgaagttccgctatgggatcgtctctttgcgccgttaatggcggcagcagctggtgcacttactaccggattatttttccatcctcatttttcactgcccattgcgcattacggacagatggaaatgaccgatattctcagcggtgcaattgtcgcggcgattgccatcgcagcagggatggtcgccgtatggtgcttaccacggttgcacgcgatgatgcatcaaatgaaaaatccggtgttcgtgctgggtattggcggacttattctcggtattctgggggttattggtggaccggtttcgctgtttaaagggctggatgagatgcagcagatggtggcaaatcaggctttcagcaccagcgattactttttgctggcggtgataaaacttgccgccctggtcgttgctgccgccagtggctttcgcggtgggcgaatcttcccggcagtgtttgtcggcgtggcattagggttgatgcttcatgagcacgttcccgccgttccagcggcaataaccgtttcctgcgctatactcggcatcgtgctggtggtaacacgcgatggctggttaagtctttttatggcggcagtcgttgtacccaataccacattgctaccgctgctctgtatcgtcatgctcccggcatggctgttattagcaggtaagccgatgatgatggtcaatcgtcagaagcaacagccaccccacgataacgtttagcaaaaaatgctctcctttatgatttaagagttatggcgatgatacggcgctttacctccccgtaatattgcgttaacaggccgctgacggcttcgatcgtgaaggagaataacaatgttcaggtcactgtttctggcggccgccctgatggcatttaccccgcttgcggcaaacgcaagtgaaatcaccctactgccatcaatcaaattacaaattggcgatcacgatcattacggtaattactgggacggtggtcactggcgcgaccgtgactactggcaccgcaattatgaatggcgtaaaaaccgctggtggcgtcatgataatggctaccatcgtggctgggataagcgtaaagcgtatgagcgtggctatcgtgaaggctggcgcgatcgtgacgatcatcgtggaaaaggccgcggacatggacaccgccattaaacgcatccgtcaatggagcacaatgcctgatgcgacgctagcgcgtcttatcaggcctacaaaccagctctttaacgcgtagggcggataaagcatttacgccgcatccgccaatggtgccaaatgcgacgctcattcaactacaatcccagtgccgttcctaccagtaaccagatattcagcgccactaccagcaccacaatcacccagcctgtctgttttacgcgtttactgttcaccagatcgcccatcaacttgctgtcactggtgaaaatcaacagtggaaccagcgccagggcgataccaaaacttaacagcacctgactcataaccagaatccgtgtcggatctaatcccatcagaatgacgataaatgacggcagcatggtgactgtacgacgcacccacagcgggatatgaaagcgaatgaagccctgcatcactacctgccccgccagcgtccccaccaccgttgaagacagtccggcagcaaccaggcttaatccaaagaccgttgccgcagcatggcttaacagcggttgcagcgtcagataagcctcatcaagatcggcaacaccagtatgaccagaaaagtggaacgccgccgcagctgtagccatcatcgccagattgacaaaaccggcaatcgtcatggcgatagccacatcccatttggtggcggaataacgttgttgacgcgaaccgccatgtaaatgctgagtgagcgaagagtgcaaataaatcacatgcggcataatcgtcgcccctaacacgcccgctgccaggaagaccgcctccgaagtaggtaaactcgggatcaccattcctttacccagctgcgccaggttaggctgggagaaaatcaactcgacaatgtaagccgcggcaacaaacaacagtaacccgccaatcactttctccagcggtttttgcccgcgacgttgcagcattaaaataaggaaagtcgcgatccccgtcagcaccgcgccctgcaacaacgaaacaccaagaatgagtttaaaaccgatcgccgcaccaataaattccgccaggtcggttgccatcgcaataatttctgcctgaacccaatagaaccacacgacgggacgcgggtagtgatcgcgaatctgctccgccagatttttaccggtggcaatccccagtttggccgagaggatttgaatcagcatcgccatcaggttagcccaaacgacaacccacaataactgatagccgaagctggcacccgcctgaatattggtcgcaaagttaccgggatcgatataaccaatcgccgcaatgaacgcaggtcccattaatgcgagcctcatcttgcgcgccgcccgtccgctgctactctcaacgcgatagttcgtcatcttgtgcctctaaaacatagcctttgctatgtttcatgctacgttaaatgagaatgattatcaaattcatttaaatgggttgtgatgatttctctgatagaccaggattatgactacggaaagatagatgactcgaatgttatggttatgtttaatattagcacatttacataaccttccgcttccatacacaacatagcagaaatgtatgacagatcactatttttgaagcttgtcacaggacgtcattatagtgtgtgtcagatctcgttttccttaaccatgttacatagaatgtgcacggaaatttaacctgcctcatatttggagcaaatatggaccgcgtccttcattttgtactggcacttgccgttgttgcgattctcgcactgctggtaagcagcgaccgcaaaaaaattcgtatccgttatgttattcaactgcttgttatcgaagtgttactggcgtggttcttcctgaactccgacgttggtctgggcttcgtgaaaggcttctccgaaatgttcgaaaaactgctcggttttgccaacgaagggactaacttcgtctttggtagcatgaatgatcaaggcctggcattcttcttcctgaaagtgctgtgcccaatcgtctttatctctgcgctgatcggtattctccagcatattcgcgtattgccggtgattatccgcgcaattggtttcctgctctccaaagtcaacggcatgggcaaactggaatcctttaacgccgtcagctccctgattctgggtcagtctgaaaactttattgcctataaagatatcctcggcaaaatctcccgcaatcgtatgtacaccatggcagcaacggcgatgtccaccgtgtcgatgtccatcgttggtgcatatatgaccatgctggagccgaaatacgtcgttgcggcgctggtactgaacatgttcagcacctttatcgtgctgtcgctgatcaacccttaccgtgttgatgccagtgaagaaaacattcagatgtccaacctgcacgaaggtcagagcttcttcgaaatgctgggtgaatacattctggcaggtttcaaagttgccattatcgttgccgcgatgctgatcggctttatcgccctgatcgctgcactgaacgctctgtttgctaccgtgactggctggtttggctacagcatctccttccagggcatcctgggttacatcttctatccgattgcatgggtgatgggtgttccttccagtgaagcactgcaagtgggcagtatcatggcgaccaaactggtttccaacgagttcgttgcgatgatggatctgcagaaaactgcttccacgctctctccgcgtgcggaaggcatcatctctgtgttcctggtttccttcgctaacttctcttcaatcgggattatcgcgggtgcggttaaaggcctgaatgaagagcaaggtaacgtggtttctcgcttcggtctgaaactggtttacggctctaccctggtgagtgtgctgtctgcgtcaatcgcagcactggtgctgtaagaccatacataaaaaagccggggtaattccccggcttttttacgcctgttaatcagctaatggctgcgggcgaccaatcaaatacccttgcagatattgcaccccgagcttatgcaatagcgcctgctgctgttgcgtctcgacaaactccgcgaccacactcaatgacttcgctttcgccagatcggtaattgatctcacaatcatcgcatccagcgtgttcgtgacgatatctttcacaaagacgccatcaattttgatgatatcagcctgcaaacgctttaaccgttcgtagttggcatatccggtgccaaagtcatcaatcgcaatccggaaaccaaacttatgcagctgctcgatgttgtacatgctgctttctgcgttagaaaacgcctgctcctcggtgatctcaagaatgaccgcctgcggggagatgtaataacgcttaaacagacgaataatccgcccggcaatattcttttgcagcagcgtgagcggcattaaattgactgaaaagcgtggaccttttttgtcgcaagggtgtgttgccagccacttcaacaaggattccagcacttgcaaatcaaaacgcgcgctaaggttaaactgagcaataaggggcagaaacttatccggggtcataatgccgccgtcatacttcagtcgcgcgaggatctcatcataaccttcaccctctttgttgcgaattggctgggcgtagagcagcaaatcaccctgatctaacgccgtgcgaatggtattcagcaatagcacctgtttagtggtttgcccggaaaccatctcctctctgctatccagcgccagcacatgatgatgtgcgcaggattgctccgccagccagcttaactgccccaacaagggttgcagggtttcctgatttccatcaaaacgcccccaggcagcaccatagcccatatccagcccggtattgttccagtgaatttgccgactattcaggatgttaaccatatgctggagtcgcccttccgtttccggcccgctcagcactaacagcagttcactacccggcaattgatacaacttttcgttttcctgcatcaacggcagcagcgtacggtaaattgagcggatacagtgaacgcgcattattaagccgtaatgacgactcataaactcaagattatcaatgcgcaggcagcaaaaactcttgcccgcctcttgctccggcgcttgctccaacgcacgaaagttgggtagaagcgttaacggatcggtcagcgcctgcaaatgccagcggcggttaagccattcactacgatgataaatacgcaccatatagagcaggcaaacactaaaggaaatcagtactgcgagaataaatgccagcgaatattcggttagtaccccttgcaaaaagttctggttgtaattcagaaggcaaagcgttgaaacagcccaggtgagatttaaaaacggatagcgaagcttaccgacaccgagggtaaagatgataaagaaaacaggtaccaggtaaccggcaataaagtcattttcatacggtgtgcacatcagaagtagcagcacgctaagagctgccagccagcttaaggtaaatgcgcgtttctctttgctcaacgacggagcgatatccctacgccacaatatctgtgcaaagtggggacttacaatcatgcgggtgagatagtaaaaaagcatgttgtaaatcagcactgcggtgaaaaggcttagcaaatcaacgaccgtgaaaatggcatccgcatcgccgaaaaaggtagatatctttagcggaaaatcaaagaaatttcccacaagatacatgctgcatttgatgcctgaggtagcctgagtttaacggacactccttcctgaaatagaatggcatcagaaggagctaataatgagcagaaaaacccaacgttactctaaagagttcaaagccgaagctgtcagaacggttcttgaaaatcaactttcgatcagtgaaggcgcttcccgattatctcttcctgaaggcactttaggacaatgggttaccgccgccagaaaagggctcggtactcctggttcccgcacggtggctgaactggaatctgaaattctgcaactgcgtaaggcgttaaatgaagctcgccttgagcgagatatattaaaaaaagcaacagcgtattttgcacaggagtcgctgaaaaatacgcgttaatcgaacaatggcgacaacaatttcccattgaagcgatgtgtcaggtatttggtgtatccaggagcggttattacaactgggtacagcatgaaccctcagacataaaacaaagtgatgagcggctaaaactggagattaaggtggcacatatccgcactcgcgaaacatatggaacccggcggctccagacggagctggcagagaatggcatcatcgttggtcgtgaccgactggcacgtcttcgtaaggagctaaggctacgctgtaagcagaaacgcaagttcagagcgactacgaactcgaaccacaatctgccagttgcgccaaatctgctgaaccagacgttcgctcctacagcaccaaatcaggtctgggtggcggacctgacgtatgttgccacacaggagggatggttgtacctcgctggcatcaaagatgtttatacgtgcgaaattgtcggctacgccatgggagagcgcatgacaaaagagctgacaggtaaagccctgtttatggcgctcaggagccagcgcccacctgccgggctaatccaccactctgatcgaggttcacagtactgcgcatacgattaccgggtcatacaggagcagtttggtctgaaaacatcaatgtcgcgtaaaggtaactgttacgacaacgctccgatggaaagcttctggggaacgctgaaaaatgagagcctgagccactatcgttttaataaccgggatgaagccatctcagtaatacgggaatacattgagattttctacaatcgtcagcgtcgtcactctcgtctggggaatatctccccggcagccttcagggaaaaatatcatcagatggctgcttaaaaaaagaacaaatggtagtgtccgctattgccagtacacctcagccaatcggcgccaccaaaccaagccagaacagacgttgccagacgtatcggctggtcaatccataacgccaacgcgtccccaattgccagcgtaatattgcacaggcacacaggactgcaaacgcctggctgccgatcatgacggcggtctgtaaaaaagtgagatgaaggttccacagattggtgcaaaacatcccgcataaaatgggaacgacaccacgccagccaaagataaacaagattgacagcattacgcacagtggcatccacgccagaaagatataattggaatggataacagcaagtggcgaaattaaacgggatagctgaataagtaccacggtgagcgtaaacgctagtgtgaatatcttgatattttttatcaggttatgctccacaaacatgagtacactactctcactgatcggggttttcaggcacacaaataataagtttattcgcatcgcgaagcaaacaggggccagcctgttgctgttttttcagtcagtgatgcattcaccacacggcactgccaggatgtagactgtattacaaaagcggcaaaaggcagagacaaaaaacccccgctttgcagcgagggtttgaaatttggtggagctaagcgggatcgaaccgctgacctcttgcatgccatgcaagcgctctcccagctgagctatagccccatcacgtaaagcttgtcgagttgacgggcggcatcatatgaattccgcccgaatgtgtcaacggcaaattgccacgtgtagtttcaatcgctgaaaaatcaggcaaatgaacaattttggaaaaccgctcgcattcagtagttattcatgtcacggtttcctgtaaagtggtgttataaaatgaactactaatagacccacatacattcagggaattgttatgttcaaggagaggatgacgccagatgaacttgccagactgaccggctatagccgccagaccattaataaatgggtacgcaaggaaggctggacaacgtcaccaaaaccaggcgtccagggtggcaaagctcgactggttcacgtcaatgaacaggttcgtgaatatattcgcaatgctgaacgtccagaaggtcagggagaagtgccagccctttctggtgatgcgccgcttgaagtgttgctggtgacactggcgaaagagatgacgccagttgaacaaaaacagtttacatccttgcttctgcgggaagggattatcggattgttacaacgcttagggattcgcgatagcaaataatatgaaaagattacgcaataaaatgaccaccgaagaactggctgaatgcctcggtgtggctaaacaaactgttaaccgttggatcagagaaaaaggctggaaaacggaaaaatttcccggcgtgaaaggcggtcgtgccagacttattctggtcgaaacgcaagtttgcgagtttattcagaacacgccagccttccataacacaccgatgcttctggaagccgaagaaccccttgccgaatacgcaccgggtattcgcactcctgcttatcggcaaatcatcagcgcaatagacaacatgactcacagtgagcaagaaaaagttgcgcaatttttgtcacgcgaaggaattcgtaattttcttgctcgtctcgacatagatgaatcagcataaataaaaaacggcaggggtatctctcctgccgtttatcttttatgcgctaattactgctgattttcgcgttcagcaataaaagccagcgctttgttgatacgctcgatactgcgggtcttaccgattgcgtgaacggtaacatccagcgccggagactgccccgcaccggttacggcgacacgcagcggcataccaactttacccatacccacttccagctcatccgccgtcgcctgaatagcgtgatgaacgttttcagcggtccagtcagtaatcgcagtcagtttgtcacgaaccacttccagcggctggcgcgctaccggacgcagatgttttttcgcggcgtcggcatcgaactcagcaaaatcttcgtagaaataacggcagctctgtgccatctctttcagcgtcttgcagcgttcgcccagcagtttcaccagatcagccagctgcgggccgttacgggtatcgatattttcctgctcaatgtgccactgtaagtgagtagcaacatactccggcggcaacgcgttaatgtagtgatggttcagccacagcagcttgtcggtgttgaacgcactggcagatttgctgacggcattcagagtgaagtatttaatcatctcttcacgagtgaagatttcctgatcgccgtgggaccagcccagacgcaccagatagttcagcagtgcttctggcagataaccatcatcacgatactgcattacgctgaccgccccgtgacgtttggacagttttttaccgtcatcgccgttgatcatagaaacgtgcgcgtaaaccggtaccggcgctttcagagccttaagaatgttaatctggcgcggtgtgttgttgatatggtcttcgccacggataacgtgggtgatttccatatcccagtcatcgacaaccacacagaagttataggttggggaaccatcggtacggcggataatcagatcatccagctcctggttgctgaactcgatcggaccacggatctgatcgtcaaaaacaacagaaccttcctgcgggttagcaaaacgtacgacacacggctcatcatcagcgtgatgctcatgactgtggcggcagcgaccgtcataacgcggcttctcacctttcgccatttgctcttcgcgcagcgcttccaggcgctctttagagcaatagcatttataagctgtgccctcttccagcatctgatcgatcaccgcgttgtagcgatcaaaacgtttggtctggtagtacggaccttcatcccactccaggctcagccagttcatgccatccataatggcttcgatagcttccggcgtggaacgctcaagatcggtgtcttcaatacgcagcacaaactcaccgccgtggttacgtgcaaaaagccaggagtaaagagcagtacgcgcgccgccaacgtgcagatagcctgttgggcttggcgcgaagcgagttttgattttcatgaaatggccttacgtttagaaagatgccgacaaccggcaaatcctggaaaaattgagtgggcgatattctatcactcccgcctgattcctcaatgtagttcgggttgcaaccttacgcattattgttttcgttgacaaattgcgcaacacggtctattttgcgatcatcttgcttaaatttacgacgaacgaacaatttctttagaaaatgcgttgactcattttgaactctccctataatgcgactccacacagcgggggtgattagctcagctgggagagcacctcccttacaaggagggggtcggcggttcgatcccgtcatcacccaccaactactttatgtagtctccgccgtgtagcaagaaattgagaattgggtgattagctcagctgggagagcacctcccttacaaggagggggtcggcggttcgatcccgtcatcacccaccactttctcgccagctagatttcttgtaacaatgtgaagtaccgaagtgggtgattagctcagctgggagagcacctcccttacaaggagggggtcggcggttcgatcccgtcatcacccaccacttcgggtcgttagctcagttggtagagcagttgacttttaatcaattggtcgcaggttcgaatcctgcacgacccaccaatgtaaaaaagcgccctaaaggcgcttttttgctatctgcaatttgcgaaattgcctgatgcgcttcgcttatcagaccaactatgtccggcagttcccgtgcctctcatctactgcgccaacgccgctagcagtttaaccagcgcgggcgtcacctgctgcgtttcataaacaatatataagtctgccgggatgcgttctttgagcggacggaatatgacaccgggccagttcatctgcgcgtagctgtccgctatcaatgtgataccaatacccatactgaccatggcgagtaccgtttgcggttcattaacttcgcgaataacaaccggtgaaaatcccacctgctggcaaactcgctgcaaaaaatcccagtcagtgtacacgggcggcattgtaacgaaatactcgtcacgtagcgcttccagcgggacggtggaaaatgatgagagatgatgctcttcaggcatcgccaccagaaacgccgattcatgcaaccgtaagctggtaaaaccagtcggtggttctgtcgccattcgccagatcccggcatcaagttcgcggcgttccagcaaggccatttgcatcgcaggcatcttttcgcgaaacagaacttcaacgttaggattttctctaaggaatcgccgcataaccgggcgcatccgtccccacattgccgttcccacaaccccgagttcaatccgccctgcttctccccgacctatttgttcaacccgagccaatacattatttgcattcaccagcaatcgacgcgattcttccatcaagattttgcccgcgtgtgtcagtacgacgctgcgcgaatggcgaataaaaagctgcgtgccgagttgattttccagctctttaatatgaatactgagcggaggctgagacatatttaaacgcgctgctgcgcgaccaaaatgcaactcttccgctacggcaagaaaataacggagcaacttaagatctgttctatatacgcgttccataattaagtgctccatataaaaaatacatcgtattaaattatcatggcataaagtatttcaccaccagatatccgacatacataaacacgatggataatatacccggcaatacatttggaacaggaataggtattcgcacgattgtaaacaaagcaccaatgccaaaaccaacgccagaagaaaataaaatatctttcactaattaacctttatcataaaagcagccccaaggaacagagctgcgaatccttttaatgtgtaactgaacgatgcgttatcttttcagggtcatggttatatttaaacccaaagaaaaatatcactgcgaggaaaagagcataccctgcaaacatcagccaaatggtatgccagtcttttacgccatccaccgagaagtaatccactgccataccgctcagaatcgagccaacccatgcgccgacgccatttaccatcgtcataaaaaggccctgggcgctggcacgaatgctggaatcaacttcctgttcgacaaagaccgaaccagaaatattgaagaaatcgaatgcacaaccgtaaacaatcatcgacagcaacagcaaaataaacccggttggtgatggatcgccataggcaaagaagccaaagcgcagcgtccacgccaccatactcatcagcatgacggttttaataccgaaacgcttcaaaaagaacggtatcgtcagaatgaaaccaacttcagccatctgtgaaactgacagtaaaatggacgggtatttcaccacgaagctatcagcaaactcaggattacgggcgaaatcatgcaggaacgggttgccaaaaacgttggtaatttgcagcaccgcacccagcatcatggcgaagagaaaaaagatagccatgcgtggatttttaaacagcacgaaggcatccagacccagcttgctggcaagcgatgtagtcgcttttttctccgcaaccggaatcttcggcaaagtcagcgcataagccgacagcagcaatgacgcaccggacgcgatatacagttgcagactactcaattccagatgcagcaagcttactgcccacatggcgacaatgaaccccaccgtaccaaaaacgcgaatgggcgggaaagcggtcaccgggtcaagccctgcctgggcaagacaggaataagagacgctgttcgataacgcaatagtcggcataaacgccatcgcattgactaacatcacccaaaacatcatatccggatcagttacggatgccgcataaaaaagtacgcccgcacacaccaggtgacacagcatgtatgcacgttctgcacgcagccatttgtctgcgatgatccccattatacccggcataataatcgcggcgatccctttggaactgtaaaccatgccaacattagcgccggtgaaatgaagggtattaatcatgtaagaaccgagggtaaccagccagctcccccagataaaatattgcaaaaaggacattacctttaagcgcaaagcgatgctcataatcgtttccttgtcgcatcatatggcctcactcagtgaggccgtttattgttgttttactcaggcaattttgcgcagaaagccgcaaataagattaataaagttttgctttgagagttccgctgctgccagcgtttgggcatgagaaagcttcacgtcactcagaccttccgccatgttggtaatcgcagagaccgcaacgactttaagttcgcaatggcgagctgaaataacctcaggcaccacagacataccaacaacatccccaccaataatttgcatcatgcgaatttccgccgcagtctcgaaattcggccccggatacgagacgaacacgccctccgtcagagggaacccctcttctttcgccactttttgtaacagtgcgcggtattccgcatcgtaggcattcgccagcgagaagaagcgctcaccaaaacgttcatcattaagacccaccatcggcgttcccggcatggtgttgatgtgatctttcaatgcgaccagactgccggcccccacttcagggcgcagtgagccagccgcattggtgcagaacagcaactcgcagcccagcaacttaaaggtacggattgcatccgtcatgatggtcatcccacgaccttcgtagaaatgtccgcgacctttcatacacgccactggcaccccctggagataacccagcaccagctcacccgcatgaccgtgtacggtacttaccgggaacccaggcagcttttcgtaggaaattgcgatcgcgttctcaatctgatcggccagcgcgcccagcccggaacctaaaataaaggccactcgtggcgtgaaatcaggtttataagtcttgataatatctacgcaatacagtgggttatgagaaaactgagcctgatacatatatatcctttttttgtagggtggaatctaacgcctttttataacgagattgccctacctcataccaatacacttttttcatgtatccgatagttattcgatatcgatatatttatattttttcactattaataggctgaaaaaactgtattggtactcttctttcccttgcattaacaatatgccgcttttaatcaacctttttattaagcaatcaactaataacgatcggcatagggaattatgctatgaaaaaacatctttttactctgacactctcttctgtattggcgataccagcagtatcccatgcagaatttaaaggcggttttgctgatataggtattcattatcttgactggactagcagaaccactgagaaatcgtcgaccaaatcacacaaagatgattttggatatctggaactggaaggcggcgctaactttagttggggagaaatgtacgggttcttcgactgggaaaacttttataatgatcgtcatgataaaccgggtagcgagcagcgttatacatttaaaaataccaaccgtatttacctgggtgacaccggatttaatctctacttgcatgcgtatggcacctacggttctgcgaatcgtgtgaatttccatgacgatatgttcctttacgggatcggctacaatttcaccggcagcggttggtggttcaaaccgttctttgcaaaacgctatacagaccaaacctattataccggcgataacggttatgtcgccggttgggttgcaggttacagctttatgctgggcagtgagaaattcaccctcaccaactggaacgagtacgagtttgatcgtgatgccacctacgcggcaggtaatggcggcaaagaaggtctgaacggtgccgtcgcactttggtggaatgcaacttcacacatcaccacagggattcagtatcgttatgcggatgacaaactgggcgaagatttttaccaggatgcgataatctactccatcaaatttaatttctgattgattactgccggagctcccggcagtatgaattcactctatatctgatacaacggatccccttcccgcccagccattagcgcattgccctggtctcgtactacgtcccataacgcttcagcggcggtggaaagtgaacggttcttcctgcgcaccagcatcaactggcgttcaaccactggcgtaatgcgctttaccaccagtgggctaccttcaggcaatggtagcgccagtgcgggaagaatactgatgccgatgcctgcggctaccatcgggaacagcgtcgccggatgaccaatctcctgcacaatattcgcctgaataccgttgcgcgccagcgctgcgtcaatcagcggtcggctgcctgacgcgtaatcctgcaacaccaatttcgctccctgtaatgcctgccaggggacataatcttccacggccaaagcgctatcgcgatggcaaagcagaaagaaaggctcggaaagaatcgcttcacattgcagatcgcccactgggcctggatcgatgacgatgccaaaatcgacatctccctggcgaatactttccatcacccactgctgcggacgatcgtgcaggacaaactgaatatctggatagcggcgatggctttcagcaatgcattgcggaataagatgcgcggaaatggtctggctggcagcgacccgaacttttccgctcagttgttgccccatacgcccggtatcgcgcaacgtgctgttaagttcatccagcagtcgctcaagacgcaaagccaactgctgccctgcatctgtaagcaccacttcacgcgtggttctgtccagcaggcgaacaccagtatgattttccagctccttcacactgtgactcactgccgactggctcaggccgatacgctctcctgcacgactaaaacttttctcctgcgctactgtgacgaaaacctttaattgctttaaagaataattcatctgtttttttcatgaatggatgcaataaatcaattttatttctcaaactggaagaagcacaatagaaccatcgatcatctggagtctttatgaaactttttcgtatcctcgatcctttcaccttaaccctgatcacggtggtgttgctggcatctttctttccggccagaggcgatttcgtccccttctttgaaaatctgaccactgcagcgattgctctgctgttctttatgcacggcgcgaagttgtcgcgtgaggcaattattgctggcggtggtcactggcgactgcatttgtgggtaatgtgcagcaccttcgtgctgtttccgattctgggcgtgctgtttgcctggtggaaaccggtaaatgtcgacccgatgctctactccggttttctctacttgtgcattctccccgcgaccgtgcagtctgcaatcgccttcacgtcaatggcgggcggtaacgtcgcggcggcggtttgttctgcgtcagcatccagcctgctggggattttcctttcaccattgctggttggtctggtgatgaatgttcacggtgcagggggcagccttgagcaggtcggtaaaattatgctgcaactgttgctgccatttgtgttggggcatctttcccggccttggattggtgactgggtgtcgcgtaataaaaaatggattgcgaaaactgaccagacgtccattctgttggtggtttatacggcattcagcgaagccgtcgttaacggtatctggcacaaagttggctggggatcattgctgtttatcgtggtggtcagttgcgttcttctggctatcgtgattgtagttaacgtctttatggcacgccgactgggcttcaataaggcagatgaaattactatcgtcttttgtggttcgaaaaagagtctggcaaatggcatcccgatggcaaacattctgttccccacatcggtgatcggtatgatggtgctgcccctgatgattttccatcagatccaattgatggtctgtgcggtgctggcgcgtcgatacaaacgccagaccgaacagttacaggcgcagcaggaaagcagcgccgataaagcttaaagcggacgcttcaggggctggaccagttgcgtcagcccctcggttttaatcagcagcgtgatttgcattagctcaccgagcttccctgccgggaactcatctttgcgggcaaaccacagcagatactcctccggcaggtcgattaagcgacgccctttgtacttgccaaacggcattatcgtattggctatttcaatcagctgctctttttccatctcagctacccagcaaacgcagcatttccgtttcgtcgatgacttcaatgcccagttcctgcgccttcgccagtttagatcctgcagcttcacccgctatcaccagatcggttttcttcgacacgctgcccgcgactttcgcccccagttcgaccagtcgagctttagcgtcatcacgcgacatctggcttaagctgcccgtaagcaccacggttttaccagcaaacggactgtcaatctcttccgcattgataacgatcggctcaggccagtgaacaccttccgccaacagctcgctgatgacattgcggttgctttcttcggcaaagaagttgtgaacgtgggaggcaacgacaattccaacatcaggcaccttttgcagctcttcaatcgaagcggcttccagcgcttccagcgtgccgaaatatgccgccagacctgctgcggtggcctcgccgacttcacggatgccaagtgcatagaggaagcgagcaaaggtggtttctttcgctttttccagcgcgttaaccacgttttgtgccgatttcagccccatacgctccagtccggtcagtttgcctgcggtgagtttgaacagatccgccggagtgtggacatattctttttcaaccagttgatcgatgattttgtcgcccattccgtcaacatccatcgcacggcgggaaacaaagtgtttcagagactctttacgctgcgcaccgcaaatcaggccaccggtacagcgggcaaccgcttcaccttccacacgctcgacgtcagaaccacataccggacaatgcgtcgggaatacaacctcacgggtatcttccgggcgttcagaaagcacgacgttaaccacctgcgggatcacgtcgccagcgcggcgaataaccactttatcgccaatgcgtaaaccaagacgttcgatttcgtcagcattatgcagtgtagcgttactcaccaacacgccagcaacatggacaggttccagacgcgcaacaggcgtaatcgcgccagtacgcccaacctgaaactcgacgtcacgcacaaaggtcatctgttcctgcgccgggaatttaaacgctaccgcccagcgcggggcacgcgcgacaaagccaagctgctcctgctgtgccagtgagttgaccttaatcaccacgccgtcgatatcaaagcccagcgtcggacggtctttttctacttcgtgataaaacgccagcacttcttccgccgattcacaaagtgttacccgatcactgacaggtaatccccacgctttaaattgcattaagcgtcccaaatgggtatccggcaattcaccgccttccagaacaccaacgccgtagcagaagaaagtgagcggtcgcttcgctgtaatacgcggatcaagctgacgcagtgaaccagctgccgcattacgtgggttagcaaacactttcccgcccgtgcgtcgcgcatcttcgttaatcttttcgaaccccgcctgcggcaggaacacttcaccacgcacttccagacgcgccgggatattctcaccgtgtagcttcagcggaatggcgcgaatagtacgcacattagacgtgatatcttccccggtggtgccatcgccacgagttgcggcactgactaaaacgccattttcatacagaatactgacggcaagaccatccagcttcagctcacagcaccaggtgactttctcgttgcttttcagacggtcctgcactcgtttgttgaaggcaagaaagctttcttcatcaaaaacgttatccagcgacagcattggcacttcatggcggatctggctgaaagccgccagcggcgcagcacctacacgttgggtaggcgaatcaggcgtaatcagttctggatgtttggtttccagctcgcgcagttcgcgcatcagcctgtcgtattcagcgtcgggaatttccggcgcatccatcacatgataaagatattcatgatggcgaagcgtcgttcgcagttctgtcagttgttgttcgattgattccatatcgcaccatcaatgctaaaaacccccgacaagcgggggttcgaagaggagttaatttgccttaagtgtatcaggcgttggcgtctttgacttcgcggatgatgtcctggtactcgcgcaatttctgcggagtcatcatacggcgctgatcgtcaagcactacaccgcccacttcatcggcaatatgctgcgcagattgcagcatcagcttaaagttctgcagctcgtcaccgtaagacggtacctgcataaagatagtgacacccggagtagtgaaatccttcatttcaggatcaaaggttcccggtttcaccatattcgccaggctgaataacgccgggccgctgccatccgggctaagatgacgatggtaaatgttcatatcgccaaaaatgaagcccgcttgttgaatgctgttaagaagcagttcaccgtttaactcgctaccgtgatgcgccgcgacgttcatgataatcaccgcctctttgcgcttcggtttatccgtaactggagccggttccgctacaggctcaggctgtggtgccgctacgggttctgcaggctggaaagcctgttgtgccggttgcggtgctgaatgcactggctgcggcgctgacgcgacctgtggcgaaacaggctgctgcaacggctgttcaggctgcggctgataggcaggctgctgcacaggttgctgcaccggctgcgttggacgcggagcatgttgcggcggtacctgcgcttcaggcggctgctggaccggttgacgcggctgcgcagacgcataaggcggttggtactggtgttgcggcgacggacgagcagcctcatgctcctgggcgttagccggggcatgattcacgcggtgaacacgaacctcaccaacgccctcatcatcttcgacatcctcgtcataagaatcgtcgtcacgttttgacttcattcgttttaatggccgatcgcggaacatagaagatcgttctttacggctggtccagaaaccatgtaccagtaaagcgattatggcgatcgcgccaacaatgattaatatcagacgcaaatcctgcatcattatattctctgttgttctaacaccttgccaccacggcaaacatttactcactaagagtatttgccgattacctcaagtgcaagtgcactattaactttcacagcacaaagatagatgaaatcgtgctttttgctgttttttcgaacatatcctaactgtccattgcgcaattacccggtaaaatacgcagaattttcctgggattggtcaaaaggagctcatcctgattatggtttcatcattcacatctgccccacgcagcggtttttactattttgcgcaaggctggaagctcgtcttgcaacctgggattcggcgtttcgttattttaccgctgctggtcaatattttgttgatggggggcgcattctggtggctctttacgcaactcgatgtctggatcccgacgctcatgagttatgttccggactggttacaatggctgagctatctgttgtggcccctggctgtcatctctgtgctgttagtgtttggctatttcttctcaacgattgctaactggattgctgctccgttcaacggtttattggctgaacaactggaagcaagactgactggcgctacaccgccagataccggaattttcggtatcatgaaagatgtgccgcgaatcatgaaacgcgaatggcaaaaatttgcctggtatctgccgcgcgcaattgtattgctaattctttacttcatccctggcattgggcaaaccgtcgcgccggtactgtggttcctgtttagcgcctggatgttagccatccagtattgtgattaccccttcgataaccacaaagtgccgtttaaagagatgcgcaccgccctgcgcacacgcaaaatcaccaatatgcagtttggtgctttaaccagcctgtttacgatgatcccgctgcttaatctgttcattatgcccgttgccgtttgtggcgcgacggcgatgtgggtcgattgctatcgcgataaacacgccatgtggcggtaacaatctaccggttattttgtaaaccgtttgtgtgaaacaggggtggcttatgccgccccttattccatcttgcatgtcattatttcccttctgcatatagatatgctaaatccttacttccgcatattctctgagcgggtatgctacctgttgtatcccaatttcatacagttaaggacaggccatgagtaagatttttgaagataactcgctgactatcggtcacacgccgctggttcgcctgaatcgcatcggtaacggacgcattctggcgaaggtggaatctcgtaaccccagcttcagcgttaagtgccgtatcggtgccaacatgatttgggatgccgaaaagcgcggcgtgctgaaaccaggcgttgaactggttgaaccaaccagcggtaataccgggattgcactggcctatgtagctgccgctcgcggttacaaacttaccctgaccatgccagaaaccatgagtattgaacgccgcaagctgctgaaagcgttaggtgcaaacctggtgctgaccgaaggtgctaaaggcatgaaaggcgcaatccaaaaagcagaagaaattgtcgccagcaatccagagaaatacctgctgctgcaacaattcagcaatccggcaaaccctgaaattcatgaaaaaaccaccggtccggagatctgggaagataccgacggtcaggttgatgtatttattgctggcgttgggactggcggtacgctgactggcgtcagccgctacattaaaggcaccaaaggcaagaccgatcttatctctgtcgccgttgagccaaccgattctccagttatcgcccaggcgctggcaggtgaagagattaaacctggtccgcataaaattcagggtattggcgctggttttatcccggctaaccttgatctcaagctggtcgacaaagtcattggcatcaccaatgaagaagccatttctaccgcacgtcgtctgatggaagaagaaggcattcttgctggtatctcttctggagcagctgttgctgcggcgttgaaactacaagaagatgaaagctttaccaataagaatattgtggttattctgccgtcatcgggtgagcgttatttaagcactgcattgtttgccgatcttttcactgagaaagaactgcaacagtaatgccagcttgtaaaaaatgcgtaaaaaagcacctttttaggtgcttttttgtggcctgcttcaaactttcgcccctcctggcattgattcagcctgtcggaactggtatttaaccagactaattattttgatgcgcgaaattaatcgttacaggaaaagccaaagctgaatcgattttatgatttggttcaattcttcctttagcggcataatgtttaatgacgtacgaaacgtcagcggtcaacacccgccagcaatggactgtattacgctcttcgtgcgtcgcgtctgttaaaaactggcgctaacaatacaggctaaagtcgaaccgccaggctagactttagttccacaacactaaacctataagttggggaaatacaatgttccagcaagaagttaccattaccgctccgaacggtctgcacacccgccctgctgcccagtttgtaaaagaagctaagggcttcacttctgaaattactgtgacttccaacggcaaaagcgccagcgcgaaaagcctgtttaaactgcagactctgggcctgactcaaggtaccgttgtgactatctccgcagaaggcgaagacgagcagaaagcggttgaacatctggttaaactgatggcggaactcgagtaatttcccgggttcttttaaaaatcagtcacaagtaaggtagggttatgatttcaggcattttagcatccccgggtatcgctttcggtaaagctctgcttctgaaagaagacgaaattgtcattgaccggaaaaaaatttctgccgaccaggttgatcaggaagttgaacgttttctgagcggtcgtgccaaggcatcagcccagctggaaacgatcaaaacgaaagctggtgaaacgttcggtgaagaaaaagaagccatctttgaagggcatattatgctgctcgaagatgaggagctggagcaggaaatcatagccctgattaaagataagcacatgacagctgacgcagctgctcatgaagttatcgaaggtcaggcttctgccctggaagagctggatgatgaatacctgaaagaacgtgcggctgacgtacgtgatatcggtaagcgcctgctgcgcaacatcctgggcctgaagattatcgacctgagcgccattcaggatgaagtcattctggttgccgctgacctgacgccgtccgaaaccgcacagctgaacctgaagaaggtgctgggtttcatcaccgacgcgggtggccgtacttcccacacctctatcatggcgcgttctctggaactgcctgctatcgtgggtaccggtagcgtcacctctcaggtgaaaaatgacgactatctgattctggatgccgtaaataatcaggtttacgtcaatccaaccaacgaagttattgataaaatgcgcgctgttcaggagcaagtggcttctgaaaaagcagagcttgctaaactgaaagatctgccagctattacgctggacggtcaccaggtagaagtgtgcgctaacattggtacggttcgtgacgttgaaggtgcagagcgtaacggcgctgaaggcgttggtctgtatcgtactgagttcctgttcatggaccgcgacacgctgcccactgaagaagaacagtttgctgcttacaaagcagtggctgaagcgtgtggctctcaggcggttatcgttcgtaccatggacatcggcggcgacaaagagctgccatacatgaacttcccgaaagaagagaacccgttcctcggctggcgcgctatccgtatcgcgatggatcgtaaagagatcctgcgcgatcagctccgcgctatcctgcgtgcctctgctttcggtaaattgcgcatcatgttcccgatgatcatctctgttgaagaagtgcgtgcactgcgcaaagagatcgaaatctacaaacaggaactgcgcgacgaaggtaaagcgtttgacgagtcaattgaaatcggcgtaatggtggaaacaccggctgccgcaacaattgcacgtcatttagccaaagaagttgatttctttagtatcggcaccaatgatttaacgcagtacactctggcagttgaccgtggtaatgatatgatttcacacctttaccagccaatgtcaccgtccgtgctgaacttgatcaagcaagttattgatgcttctcatgctgaaggcaaatggactggcatgtgtggtgagcttgctggcgatgaacgtgctacacttctgttgctggggatgggtctggacgaattctctatgagcgccatttctatcccgcgcattaagaagattatccgtaacacgaacttcgaagatgcgaaggtgttagcagagcaggctcttgctcaaccgacaacggacgagttaatgacgctggttaacaagttcattgaagaaaaaacaatctgctaatccacgagatgcggcccaatttactgcttaggagaagatcatgggtttgttcgataaactgaaatctctggtttccgacgacaagaaggataccggaactattgagatcattgctccgctctctggcgagatcgtcaatatcgaagacgtgccggatgtcgtttttgcggaaaaaatcgttggtgatggcattgctatcaaaccaacgggtaacaaaatggtcgcgcctgtagacggcaccattggtaaaatctttgaaaccaaccacgcgttctctatcgaatctgatagcggcgttgagctgttcgtccacttcggtatcgacaccgttgaactgaaaggcgaaggcttcaagcgtattgctgaagaaggtcagcgcgtgaaagttggtgatactgtcattgaatttgatctgccgctgctggaagagaaagccaagtcaaccctgactccggttgttatctccaacatggacgaaatcaaagaactgatcaaactgtccggtagcgtaaccgtgggtgaaaccccggttatccgcatcaagaagtaattcttgccgcagtgaaaaatggcgcccatcggcgccatttttttatgcttcagccagaggcggcaaaatcaattcatcgctctcatgctgctgggtatagcgcatcacttccagtacgcgcaaccccgcgcggtgtaccgcatcggttaacgccttccctttcaacaaaccactgataagctgagcacaaaacaggtcgccagtccctttcaggtcagttttaacccgggaatgggaaatgacattcacgctgtcggcactgaccaccaccacctgcatctcctgattttcttcattgccggaggcgctggtaatcaccacccactttaatgtgtctgaaagcagactttttgcggcagcaatggcactgtcgagatcgcggcaatctttaccggtcaggatttccagctcaaagatattgggggtaattccctgtgccagcggcagtaaatattgtcgatacgcctcgggaaggtcaggtttgacataaattccgctatcaatatcgccaatcaccggatcgaccatgatcaataggtcaggatggtctttgcgtagcgcagtcagccactcggcaaggattttgatttgcgatgccgttcccatatagcccgtggttacagcacgaagttggcgcagcgcatcacgctcctgaagcgcacgcaaataaccgctaaaccattcatccggaatcgcaccaccgtagaaagtgtcataatgcggcgtattgctcagcaataccgtcggcacggcaaagacattcaggccgttctgtttgatagcaggcaccgcaatgctgttgcctacgctgccgtacactacctgcgactgcacggcaacgatatccgcctgcagtgccctgctcttatcgttaaacaacaacaaactactcatttaattttttctccttgccgatgatcctcatcgtattccaaccgaaactttacctgattctggcagtcaaatcggctattacaaaacaaggataaggtaattcagtgaagaaaatcatttgtctggtcgttacgctgctaatgacactccccgcttatgcgaagttaacggcccatgaagaagcccgtatcaacgccatgctggagggattagcacagaaaaaggatttgatatttgtgcgcaacggtgatgaacatacctgcgatgaagcggtttctcatctgcgcctgaagctgggcaatacccgtaatcgcattgatacagccgagcagtttattgacaaggtggcctcgtcgtcatcgattaccgggaagccgtatatcgtgaagatgcccggtaagagcgatgagaacgcacagccttttttacatgcgttaattgcgcagacggataaaacggtgcctgcgcaataatcttaaatccccgccccctagctaaaatgctcttccccaaacaccccggtagaaaggtagcgatcgccacgatcgcagatgatcgccaccaccaccgcgccagggttagcttttgccacccgcagtgctccggcaaccgcgccgccggagcttacgccgcagaaaatcccttcccgcactgccagttcgcgcatggtgttttccgcatcgcgctgatgaatatccagcacctcatccaccagagaagcattgaaaatccccggcagatattccgcaggccagcggcgaatgccgggaatactgctgccttcttccggctgcaggccaacaatggtcaccggtttggattgttcgcgcataaagcgtgacacgccggtgatagtgccggttgttcccatgctggagacaaaatgggtaatacgcccgccagtttgctgccagatttccggcccggtagtggtgtaatgggcgtaagggttatcgggattattgaactgatcgagcaactttccttcgccgcgattcgccatttcaagcgccagatcgcgtgcgccttccatgccctgttctttggtgaccagaatcagttctgcaccgtaggcacgcatcgccgcacggcgttcctggctcatgttgtcgggcatcagcaatttcatgcgatagcctttaagcgccgcaatcattgccagcgcaatgccggtgttaccactggtggcttcgatcagcacatcacccggtttaatctcgccgcgcttttccgcctcgacaatcatcgaaagcgccgcacggtcttttaccgatcccgccgggttattgccttccagttttaaccacacttcactgccgttatccggcgccattcgctgcaacttcaccagaggcgtattgcctattgtttgttctaatgtactcacgatctctgtccatacgtggtgttgcctgatgcgacgcttacgcgtcttatcagacctacaggttacaaaaccttgccattaaaaagcccggatcgcgggaagcgcctccgggcgtttaacattcactcaacctatcaggcgctttgtgcgagagcaagttcctcatcgcgggtttcaatacgctcatcgccgttatacagccgcgcatgttgcagaccaacgtataaacgatcgccacgctgcggggcatcgtcgccatgcatcacgaccgtcagcggttcgttgtaccaccccagcggctgcaccactaattgggtgtagtgacctttcgggctggcttccagtacctgtacgggtagcggcgaatcgaggctggtacggcggctgatatccacttcccacgggcgcaggaagagatccaccggcccctgatacgcgggggtgtatcccagcggccagcgatgtgcgccaacgtggaactgcccgccgcgaatggttccctgcaggcggtttacctcgcccataaactccagcacaaaacgagtcgccggttcacgccatacctgatccggtgcgtcagcttgttcaatattgccctgactcatcaccactacacgatcggctacttcggtcgcctcttcctggtcgtgggtcacgaacacgctggtgaatttcagttcttcatgcagttgacgcagccagcgacgcagctctttacgcacctgcgcatccagcgcgccaaacggttcatcaagcagcaaaatttgcggttccacagccagcgcgcgtgcaagcgccacacgctgtttctgaccgccggaaagctgcgccggataacgatccgccagatgagcaagctgcaccatctccagcaattttgtcactttcgctttgatcgccgccgcattcgggcgttcacgccgtggcaacaccgtcaggccaaaagcgatattgtcaaacaccgtcatatggcgaaacagcgcgtaatgctggaacacgaaaccgactttacggtcccgcgcgtgcagacggctcacgtcggtaccgtgaaagcgaatatgcccactggtttgatgctccagcccggcgataatgcgcagcagcgtagttttcccggaaccggacggcccaagcaacgcgaccatctgaccagaaggaatatccagtgagatatcgttcagcacctgggtgcgaccaaaagacttcttaatattggcaatctcaatgctcatgatgttcctcctgctgcgcgcgtttttcctgattttccaggcgccactgcaacatactctttaaaaacagggtgataatcgccatcagcgtcaacagcgcggcggcggtaaaggagccgacggtgttgtagtcctgctccagcaattcaatctgtaacggcagcgacagggtttcgccacgaatcgagccggaaaccaccgataccgcgccaaactcgccaatcgcgcgggcgttggtcagcaccacgccgtaaagcagcgcccagcggatgttcggcagcgtgacgcgacggaacatctgccagccggacgcgccaagtaaaatcgccgcttcgtcttcctggctgccctgacttaacattaccggcaccagctcgcgcaccacaaacggacacgtcacgaagatggtgaccagcaccatacccggccaggagaacataatttgcagattatgttcatccagccagccgcccagcgggccgttagagccgtagaacagcagatacaccagaccagcaaccaccggcgacacggcaaacggaatgtccagcagcgtcagcaatagctggcgtccggggaagttaaagcgcgtcaccagccaggccagcagaataccgaacaccaggtttaccggtacggcaatcaacgcgatcatcaccgtcagccagatggcgtgcagcatgtccggatcggccagattttgtaacactggcatcagccctttgctgaacgcctgtacgaagatataaatcatcggtaccagcaggatgaacgccgataccagcatcccgatgccaatcagaaaccatttgccccagttaatcgggcgcgcgtcataacgcttcaattgtgtcacttccgccattaatgacctaccacacgccgaccaaagcgactttgcagagtgttaattgagaacagcaacagcagcgatgccgcgaggatcaccgaggcaatcgcgctcgccgccgggtaatcaaactcctgtaagcgaacaaagatcatcagcgacgtcacttctgttttccaggcgatattcccggcgataaaaatcaccgcgccaaactcaccgaggctgcgggtaaacgacagcgccacacccgccaccagcgccggagatagttccggcagcaccactttgcgaaaactctgccagcatgttgcgccgagcgtttctgccgcctcttcatattccgggcctaactcttccagcaccggctgcacggtgcgcaccacaaacggaatgctggtaaaggccatcgccaccgcaatccccagccaggtataggtgactttgatatcaaacttcgccagccattcaccgtaaaaaccgttcacggaaaagagcgaggccagcgttaaaccggcgactgccgttggcagcgcaaagggtaaatccatcagcgcatcaagcagcgtgcgacccggaaagcgatagcgggttaagatccacgccatcagcagaccgaaaacgccgttaaaaatcgatgccacaaacgccgacagcagcgtcactttataggctgcgaccacctgcgggttggtgatcacctcccagtactgcgcccagctcatctgggccagttgcatcaccagcgcggagagcggcagcagcaaaatcaggcacacaaacagcagactggtgccgaggcttaaggtaaagcccggcagcacgcgtcttgaagaaactgcaaacattacttacgccccgccgctaacagcttgtctaactcgccgccgctggtgaagtgggttttcatcacttccggccaggagccaaatttatcttccacgcggaacagctcggtctgcgggaatttatctttcagtttgcccatgacttccgggttatttacgcggtagtaatagtcggtgatgatggtttgcgcctgcgggctgtagagccagttcaggtaggcttttgccgctttttccgtgccgttggcctgtacgtttttatccacccacgccaccgggaattccgccagaatgttggttttcggaatcaccacttcaaagccctgcgcttcatactgtttacggatgttgttcacttccgactcgaagctgatcagcacatcgcccaggccgcgctcggcaaaagtggtggtcgcgccacgaccgccagtatcgaacacttcaacgtttttcaggaactgggtcataaactgttcggttttggctttatcaccaccgtcggctttgtccgctgcgccccatgccgcaaggtaagtataacgcgcgttacccgacgttttcgggttcgggaaaatcagcttcacgtcagagcgtaccaggtcgttccagtcgtggatattcttcgggttgcccttacgcaccaggaagcccatggtggagtagaacggtgagctattattcggcaggcgcgactgccagtccgctgggatcagcttgcctttatcgtgcaggatttgtacgtcggtcacctggttataagtgacaacgtcggcttttaaaccctgcaaaattgccagcgcctgttttgatgatccggcatgagattgtttaatcgtcagtttgtcgccaccgttatcttttgcccattgttgctcaaacggcgggttcagggcggcaaacagctcgcgggagacgtcataagaactgttcagcagttccgttgcctgtacatggcccgccagtagcagagaagcaaccagcacgagtgagttctttttcagtaagttaacggccattgcgcacccttataaatttaatgactttctaatagccatcatatttataacggacgtgaaaggagtaacggttttatataccgtttggtgatttggaagttgaaaagggaataagacgaaatcctccccacaaatgcagggaggaaacagaggtgaatcagatgccgacgctaaccgtctccggcagtgtgctgccgccatcaatcacattctgtgtaccggttaaatagctggattcatccgatgcgaggaaggccgccagttcaccgacttccagcggatcggcgaggcgacgcatcgggattgctttcgccatttcagtcagcaccgattctggatcttccgggttcgactggcgggcaatgctttccgccattggcgtgcgaacgtatccagggcagatggcgttaacgcgaataccagactgcgcgtactccaccgccagcgatttagtcaggccaacaatcgccgctttcgttaaggcgtacgccgtttcgcccgggtctgccaccatatcgccagtgactgaagacatcatcacaatccggccatctttgcgggcaatcatctccggcagcaccgccttcgtgacgttccatacgccttttatattgatatcaatatggaaatcgcgatcttcatcgctcatatcaaggaaactgcccagacgacaaacgcctgcgttattcaccagaatatcaatgcgcccttctttttccttagcgcgcttaatagctgcggctaccgacgccgggtcacgcacatcggcgacaaccgccgtacagcgatgaccacggccacacagttcgtccgccagcttttcgatctcaggggagatatccagcaagattaggtttgcgccatgacgcgcaaaagttctggcaattccttcgccaattccctgcaatgcgcccgtaatcagtgctgtcttgcccgtgagtttacccattttaatgctctccttgttaatacagagcgttacactccattccctctgaaaatacaggataaacaaaatattgctgcggatcagctcactaattcaggaaaatctcaatttagtcgctgctttatgcagcacctcaaacgttacgtcagcgcgcaatcattttcagtgacatcacatgagtaatattcggacttaatgattcctttgtgtctatcaaatcgggatatatgatcccatttatctgcaattatttgatcgcaaatattaaggtcaccaccgatgcaacttgaaaagatgattaccgaaggctcgaacgccgcctcggctgaaattgaccgcgtatcaacgctggaaatgtgccggattatcaacgatgaagataaaaccgtaccactcgccgttgagcgcgtactgccggatatcgccgcggcgatcgatgttatccacgcccaggtaagcggcggcggccgtctgatttatctcggtgcgggaacatccggtcgtctggggattctggatgccagcgaatgtccgccgacctacggcgtgaaaccgggcctggtggttggtttgattgctggcggcgaatatgccattcagcacgcggtggaaggcgcagaagatagccgggaaggtggtgttaatgatctgaaaaatatcggcttaaccgcgcaggatgtggtggttggtattgcggccagcggacgcacgccgtatgtgattgccgggctggaatacgcgcgccaactcggctgccgtacagtgggcatttcctgtaatccggggagtgccgtttcatccaccgcagagtttgctattacgccggtagttggtgccgaagttgttaccggttcttcgcgaatgaaagcaggcacggcgcagaaactggtgctcaacatgctctccaccgggctgatgattaaatccggcaaagtgttcggcaacctgatggtcgatgtggtcgccaccaacgaaaaactgcatgtgcgccaggtcaatatcgtcaaaaacgctaccggatgtaatgccgaacaagcggaagcggcgttaattgcttgcgagcgcaactgtaaaacggctattgtgatggtactgaaaaatctcgatgccgatgaagctaaaaaatgcctggatcaacacggcggttttattcgcaaggctctggaaaaggaataacccatggctaaagagatcagcagtgaacttctgaacaccattcttacccgggtcggcggaccgggaaatatcgccagttgtggtaactgtatgacgcgcctgcgtctgggtgtacatgacagttcattggttgatcccgatatcaaaacgctggaaggcgtgaagggcgtcattttgaccagcgatcaggtgcaggtggtttttgggccaggcaaagcgcatcgtgccgcaaaagccatgagcgagctgctgggcgaggcaccggtacaggatgccgcagaaatcgccgcccagaataaacgccagttaaaagccagacaaacttccggcgtgcaacaatttctcgccaaattcgccaccatcttcacgccgctgatccccggttttattgccgccggtctgctgctggggatagcgacgttaattgccatggtgatgcacgttccggcagatgctcagggcacgctacccgatgcgctgaattttatgaaggtgttcagcaaaggcctgttcaccttcctggtaattctggtgggctataacgcggcccaggcatttggtggcacgggcgtaaatggcgcaattatcgctgcgctctttttgctcggttataaccccgctgcaaccacgggttactacgccggatttcacgatttctttggtctgcctatcgatccgcgcggcaatattatcggcgtgttgattgccgcatgggcctgcgcccgcatcgaatgcatggtgcgccgctttatgccggacgacctcgacatgctgttgacctcattaatcaccctgctgatcaccgctacgcttgcgtacctgatcattatgccgctgggcggctggctgtttgaaggcatgtcgtggctgtttatgcacctgaacagtaatccgctcggttgtgcggttttagccgggctgttcctgatcgccgtggtatttggcgtgcatcagggctttattcctgtttatctggcgttaatggacagccagggattcaacagcttatttcccatcctttcaatggcaggcgcaggccaggtgggcgcggcgctggcgctctactggcgggcgcaaccgcacagtgcattacgcagtcaggtccgcggggcgattattcccggtctgcttggcgttggcgaaccgctgatttacggtgtcaccctgccccgcatgaaaccgtttgttaccgcctgtttaggcggcgcggcgggcggtttgtttatcgggctgatagcctggtggggtctgccgatgggcttaaatagcgccttcgggccgtctggtctggtggcgctgccgctgatgacttccgcgcaaggcatccttccggcaatggcggtttatgcaggcgggattctggtggcatgggtttgcgggtttattttcaccacgctctttggctgccgtaacgtcaatctggactgataatatgaaacggacaatgctctatctttctctgctggctgtcagctgtagcgtcagcgccacaaaataccctgttctgacagaaagtagttgatcaagtgtatgcggcgttaaagcagtaataaaaaggccagtcagttgtgttactgcctggcctttaatcaatgaatcagaaacgcttacagcgccatcaacttgtccagcgacggcgcgaagtaatagccgccggtgaccggtttggtgaaacgcagcatcgcatcacgcttaccatcggtatcgccaaacatgctcagcagttgctgctcaatgttatgcagacgcgcgcagtaggcgcagaagtacagaccgtgagtgccactggcggtgccgtacggcaggctctgacgaacaatcttcagccctttgccatcttctttcagatcaacgcgggtcaggtgagaggtttccggacgttcgtcgccgtcaatctcttcgttggcctctttggtgcgcccgatcatcatctcttgatcgtgaacgctcatccgattgagctgcttcaggttgtgctcccaacgctgcacaaacacatagctgccgcccgcatccacgccgtctttgataacagccacttcgcggcgcgtctcttcacccgccgggttttctgtaccgtcaacaaagccgctcaggtcacgctcttcaacccaacggaagccgtggatctcttctttcacttcaatgcagtcaccaaaggcttccatcgccgcctgagcgacagagaagttcacgtcgtgacgcagagaaagaatgtggatcaacacatcgaactgggtcgtcggtgcaagacctttaccgtagcccggaaaatctttcagctcttcggccccaacgccgccgctcagagcgcgccaggtattgttaccaaaggcaaccaccgcaccaagatgcgcgtccgggaatttcgcttcaaaagttgccagtttgtcggcaaatgttttactggccgcacgcagggcgtcaacttcccctttcacgttggcttcgatccaaatcgccgcgcggcaatgttctggcaaaatgccactctgaacctgagacattgttcctcctgaaaataataatgccacgcaatccgtggcattgttgggcgctattttacgtgttttttcgcggcggcggtttgttcagacgcaaattaacgccgccagataattttactgactttccagtttttcagggtatcgtccgaaggcattaacccttcagggccactccattccccgctgaactggtagctaatatgttgactgccttcggctttacattcgacggcacgattatcatcactgtcggccttttggcaattgccaaatgctttgctgtaaaggtcactaaacggtgtaccgattttaacaccggtgtcagcaggaatatcgctatccagcacatcaatgcggctgatcgtgccttgatcaccgttaatcaccatcgccacgttgtcgcctttcatcacttcaaaaaagcgcaccacgttgccgttcgcggttttcattccgctgcgcaggcgataatcgccatcaagcgcatcagcaatggcttgttcttgcagtggtgtggacgccgttaattcacccacgccctgctcgctcactttggtggatgatccaaaccagttccacgggttagcggccgaccagttaactgacgacatcgtggaacagccggtcagcatcaacggcatagcgcataacattaaacgcagcgatttcatgtcacttcctttggttattcaataacgttgattggagtgcaaattcaccaaaaagtgccgttattctttttcttcattaaaacaagcgcgtaaacgtcgattggtcagcagccagattaacgccacgatatccgccactaccagcgccagaccgataccgctaacggattcaccgttcagccacagccacggttgccaacaaagtaaaaccacttgcgccaacagcaacagaaaatagagcacatgccagatacggggaaatgaagcccgccgaccactcagcaaaaatgccagcaccgccggaataccgggaatcaaccccagccagaaattatcgtgatcgggataaaacagatttagcagcgcagtaccctgctcgcgcgacgctccggcaatgacaaacagcacccaggttcgcgcctgaagcaatagcacaagccagaagagcaagggtaaacgcaggcgaccgtgcgcatcataatggacaggatgaaactcagcactcttcatcttcaatcaaacgcttacccagactcagcacgtcggcgtgttcatatcccaggcgttcatacattccgagcaccatgtcgttatcttccggcacgttgatctgaattttcggacagccgcgagcaatcagctttttctccagccgattaagcaacgcattagcaatcccacgcccacgaaactcgggatgcacgccaagataataagcagacccgcgatgcccgtcataaccgcccatcaccgttccgaccacttcaccgttcacctcagcgaccagaaacaaactgacgtcatggttcatcttacgctcaatgtccatttccggatcgttccacggacgcagcaagtcgcaacgctcccaaagggtgatgacctcttcgaaatcttcctggcgaaatacgcgtatctccatggtattcgttacctttttgcgggttaaaaggctgattatggcgtgaacggtcgaattagccaatatctgacgaaaatcggttgaaaaagtggcataatggggagttgtcaactattgaaatgaaaagtaaaacaattctcaacagcaaaccgtcgtaacggattacgcgatacgatataacatctggaactttattattacaactcaggccgtatgagcacttttaaaccactaaaaacactcacttcgcgccgccaggtgctgaaagccggtttggctgccctgacgttatcaggaatgtcgcaagccatcgccaaagaagaaccgttaaaaaccagtaacggacacagcaagccgaaagcaaaaaaatctggtggcaaacgtgtcgttgttctcgatccaggccacggcgggattgataccggagcgatcggacgcaacggttcgaaagaaaaacatgtggtgctggcaattgccaagaatgtccgttccatattgcgtaatcatggcattgatgcgcgtttaacgcgttctggcgatacgtttatcccactgtacgatcgcgtggaaatcgcccataaacacggcgcagacctgtttatgtcaattcacgccgacggttttaccaacccgaaagctgccggtgcttcggtatttgccctctctaaccgtggggcaagtagcgcaatggcgaaatacctgtctgaacgcgaaaaccgcgccgatgaagttgccggtaaaaaagcgactgacaaggatcacctattgcagcaagtgctgtttgatctggtgcaaaccgatactattaaaaacagcctgacgctcggctcgcatattctgaaaaagattaagccggtgcataaactgcacagccgcaataccgaacaagccgcgtttgtggtgttgaaatcgccgtcggttccgtcggtgctggtggaaacctcgtttatcaccaacccggaagaagagcggctgttaggcactgcagcgtttcgccagaaaatcgccacagcgattgccgaaggcgtgatcagttatttccactggtttgacaaccagaaagcacactcgagaaagcggtaagtgatgaaacccgacgcacaccaggttaaacagtttctgctcaaccttcaggatacgatttgtcagcagttgagcgccgtcgatggcgcagaatttgtcgaagatagctggcagcgcgaagctggcggcggcgggcgtagtcgggttttgcgtaatggtggtgttttcgaacaggcaggcgtcaacttttcacatgtccacggtgaggcgatgcctgcttccgccaccgctcatcgtccggaacttgccgggcgcagtttcgaggcgatgggcgtttcactggtagtgcatccgcataatccgtatgtccccaccagccacgcgaatgtgcgcttttttattgccgaaaagccgggtgcagagcccgtctggtggtttggcggcggcttcgatttaacccctttctatggttttgaagaagacgccattcactggcaccgcaccgcccgtgacctgtgcctgccatttggcgaagacgtttatccgcgttacaaaaagtggtgcgacgaatacttctacctcaaacatcgtaacgaacagcgcggcattggcgggctgttctttgatgatctgaacacgccagatttcgaccactgttttgcctttatgcaggcggtaggcaaaggctacaccgacgcttatttaccaattgtagagcgacgaaaagcgatggcctacggcgagcgcgagcgcaattttcagctctaccgtcgcggtcgttatgtcgagttcaatctggtctgggatcgcggcacgctgtttggcctgcaaactggcgggcgcaccgagtcgatcctgatgtcaatgccgccactggtacgctgggagtatgattatcagccaaaagatggcagcccggaagcggctttaagtgagtttattaaggtcagggattgggtgtaactccctcacccccactcccgcatccgctgatgcagcgtcagtgacggcttctcggcaaacagttgctgataatccgtggcaaattgcccaagatgccagaatccccactgcatggcggcgtcttttaccgttgtgctttgtgaccacggacttatgagttcgcggcgcacggcgttcaggcgaatacgtttcagccacgcgttcggaccaatgcccaaaatggcgtgaaacgcgttttgtagcgtgcggcggctgacatgcagttgattacacaagtccagcaccgtcaccggttcggacatgttttccagcacatattcacgggcgcgggaaagcaatcgacggtaactctgatgactgatgctttccgccgtcatcatcggctgcgcttcttccagcatcgcccccatcgccattagcaaattatcccccagcacttttcgcactgcaggctgatggagattttccgggttctcgcaaaacgtcgccagcgcctgttggacaaagccccacagcgcggctttatgctgctctttcacttccagcgccgactggctacgcagcatatgtaatacccgatccggattatgcaaaaagttagcctgacgagtgatgacatcttcagaaagcactacgccaaggatcgtgtaatcgtccggcgtacttaattcaaactcggttccaccagggcgcgtcgcaatttctgcacttcccagacattgcgaaccgataaatccctgctcaccgcgcgtcgccggaatgccaaaccagaacgagttcggccagaccaggcacgactgacgcagcgccagaccagtgtattcacgaaaaacctgaatatcatcgagtagaatttccgtaaattcaccatgaaacttgcccggatgcagctgatcgtaaatctgctgccaggcggtaattgtcaaagcatgttcatagacgtccgttgtctgtcgttgatgaacattatccacttcgaccttcggcgtgagcttcaggttttcgggtaagggttcatgataaagatggtgcaaattggctgtacgggtctttttcatgatgttaatgccgggtgttgtaggacacccggcacctccgacaggttaatggggcttgagacggtaacgactactgcgtttacgtaacgtcccggcagaaaagagctgttcgagcgcatttctggctttttccagcggccagccaaagtgggcagccacttctcctgccgtcattccctgacgtactgatgttaacagcgccaacaactcgtcagcagattccgcgacgataactggcgcgtcgggttcctttacgggttgcttcggctggcggttaaagccagtaaccagccactgggtgtcatcgtctggccgaccgatctccttacggctgatgacacgcccggtacgcatcgcggcagcacaacctgcgtccagcgccgcacgacacgccgccagatctccttccaccaccagcgttaggcgaccagggtcaagcacttcgtgactgagcagacgaacgttagctgctttgagcatggcatcagctgcatctatcgcggcgaccatgccgtccacttccagcaatcccagtgcattgatcatcggcaacctccgttacgcacgctggattggattacgcgcgatttccagcactgcatcggtaaaggcgttacaggctgctttacacgcggcctagctaccggttaaaaatgctgccgagtagttggtttcagacggtggcgggacataggtcaccagctgcacgtcggcagatttcaacgctgcatcaatgccgtaggtcgcttccagcggcggtgccaccagatacgccatcggatcgccaagcgtgatcccggcggttgatgagagataagaaccggtacgcgaaactacatgtgccaggaaggctgtgttttctgcgtcattagcccactggaaagcagcgccattttcaatatttgcaaccatcgcatccagaccagcacgcacttccgccgggtttggtccaccaagcataatcagcacctcaccggcagtcggtgacgggccgtgtgcagcgcccgcatacagcgagcgaccatataccacttcgaccatcgcctgcttggtcgcttcgtcagccgcaatgtaggtgacgtcatctgaatcagcagaaatcagcccgaggctacgaatatgcggcggcaatttcagttcacgtgcaaattcggcgttaacggaggcaatcacccgcatggcggttaccgacggtcgaatcaaatctaaagctggcatgatgcctccttatcgggtcatgttgatgccggatgctttctgctccagcatacgtttcgccaaatccacaatgacggctgcggcttcaaccggcggcgtgccgccctggtgaatattagagatacaggtgcgatcggcctcaacggtggtcgccatacgcggcgagtaaacggcgtagcaggagaggctttctgactgccccaaccccggacgttcgcccaccagcaggatcactactttcgcgcctaggatctcaccgatctgatcttcaatcttcacgcgaccataacgtacaaagaatggcgtaccgactttcagcccggcttgcttcaggcccgccatcagcggcggcaggatctcttcgtagttcacggtgatcgcatcagttgacaggccatcagaaataacgacctgcacgtccggattagcaacacactgtgctttcagcgcttcaacagcttctgcacacaggcggcggcccatatccggacgagtcaggtagagatttttgtcgctgatttcggagcggacttccagcaagccctgcgctttcacccactcttccggtacttctttcagaacggtatctttcgaacgagagtgatcggccaggaaacgcagcaacgcctgggtgcgcggacgcggaccggcacgaccggtacaaacgcgggccacggtgctgcgacgcagttctgttaatacgtccgcgcgatgtgggttttccacaccaatccacgcttttgcttccgcagaacctaaatccagcgcgcagctttccgaggtcaccggtgccgcacagttggtggtggtgcactttgcttctgacggcgcgggggccgtttgtcccattgacgccatcacactgcgtacaatttcttcaatctgtttttgatccatgatgtgttatctccgcgtcatcagaagaacagtgacggatcgcccgcccgtttggtcaggcgaccgtttgccataatgcccatgctttccagccagcgttcaaactccggtgacggacgcagattcagtaactgacgcacagtggcagtgtcgtggaatgcggtggtctgatagttgagcatgatgtcatcacccagcggcatccccatgatgtagttgcagcctgcggtggcgagcaggatcatcaggttttcgttgaggttctggtcagcgtcagcgtggttggtgtagcagcagtcacagcccatagagatgccgctcagcttgcccataaagtgatcttctaagcccgcacagataatctggcggtcgttgtagagatactccggcccaataaaaccgaccacggtgttgacgataaacggatcgtaatgacgcgccagcccatagttacgcgcttccatcgtcacctggtctgcgccgaagttagcgccagcggatagcgccgagccttgtccggtttcgaagtagagacagttttccccggcgatacggttgaactccgcgcccactgcgcgtgcttcatcgagcatcgccagctctacgccaaactctttcagccctttttcgctgccgcagatactctggaaaatcagcccgcctggtgcgccacgacggatcgcttcgatctgggtggtgacgtgcgccagtacgcagccctgagttgggatgttgaatttgtcgatcacgccatagatggtatccaacacgcggcttaagttttccacgtcgtcagtcaccgggttaacgccgatcaccgcatcgcccaccccgaaggaaagcccttcgtagatttgcgcggcgatactttgcacgtcgtcacgggtatcattcggctgcaaacgggcgctaaaggtgcccggaataccgatggtggtattggcctttttgatcaccggcattttcttcgcgccgtagatcaggtccgcgttggagcaaatcttcgctaccgccgccaccacttccgaggtcagccctttgcgggtaaaggcaatgtcgtccacgctgatttcatcgctcagcacatactcacgcagttcgctgatgctccagtttttaatctggttataggccgtttcgttaacgtcgtcctgaatcagccgcgtcacgcagtcatcttcataggcaatcaccggattattgcggatgtccgctacggtcatttccgacaacacctgctttgccgccacgcgctcctgtgaacttgccgcagcaacgcccgccagcacatcccccgaacgcagttcgttggctttagccagcacctcttttacatccttaaactgatatacattgccgaacaatgtggtctttagtttcataagtcgttccctcaggaaggaaatgcgagtgatttcaccgtcaccggcacaaccgatccgccaaaaagaggcgtaccaatgtcgatatagtcccccgcgcggacaatcacttcgtcaatgactgccaacgggagttgttgtagctgtgggcgcaacaacatgcccagagctttaccaaagtcctgcccggccaccaccagcaggggatgcggattcggaaaacgcgcgacgaaatcgaccagcgcgttgatgaccgtcagtaccgcggcgtaacgcacaggcagcgaggcgggaagcgccagcacgtacgcgtcagttttggggcaaagatccagttgaatcagcgcctgttgccaggcactgaccagatccgtttcatcaatcgggatcgccactggcaaattgcgcagcggcagttgtacgccctccagccagattgtgctgccagagagcgaaagggtatgagcacccgcgccaatcaccgtggcgcgcacggtttgcgccggaaactgcacgttcatctcacgcagacgcggatggtcatgcagcgccgttgccagaagcgggccgatatcggcaaaacagaacgggtcggtgggctggtggcgataacattcgcctaccccgccagaaagcgtaatgatttcgggcgtaacacctgcgggcagcaaaccggtttgcatcaatgcctgcgcgagcggcgagagcgttccgtcaatcacttcgacaatcagctctgccatccggcgggtaacctgcaccagctgcccgccagtcagcgaacgggcgtcagtgcctgggccgaagcactcatccacaatcatctgccccggtttatgagcgtaaaccacgcgcccctggctgtcggtttccagcaggcgaccgccgacgttgaggcaggcagtcccgctgatttttccggcatcgaacagggcgtagttcgcggtgccaccgccgatatcgatattcaggacccgacacagccgttgttcagaaagggtttgcgccccggcaccgtgaccggcgatcacggattcgagatgcggtccagcgctggcgacgacaaaatcgcccagcgaccgggagagggccatcaccgccgggcgagcgttgcgggtttttgcgctttcaccggtgataatgatggcaccagaatcaacgctttccggcgcaatgcccgcagcctgatattgcttgaggattaaggttttcagttccgcttcttttaaaccaccctgtttatcgacaggggtaaagaacaccgggctttgccagctaatttcgcgtttgatgaattcgtagcgcggcacctgcgacaccgccgcacggttaaccagctccaggtgggagaagatcacctgggtggtggtggtgccgatatcgataccgacgctcagtagctggcgagtgttcacgattgcgcctccgcttcagttttagccgcggtcgcgtcttcttttggcaccagcatcatcgccacgccaattgccgttacgccgccgatcaatttgccgacaatcatcgggaagatcatggcgttcatgttggcagcggcgaagcctaaatggtcgcccagcgcgaaagcagcggaaacggcgaaggcgcagttgatgactttgccgcgggtatccatctgcttcatcatgccaaacatcggaatgttgttggcaagcgttgccaccatgccggccgccgcgatattgttcatattcagcaccttaccgacgctcatcagcggtttttcaaaccagcgagtcagcagcagtaccattggatacgcccctaacagaacgcaggagatcgagccgataacttcaatggcgcgcatcacttcaccgggtttatcgccaggggccataaagataggatcaagacccgggatcagttcccagccaaggaggaatttcactaccgcagcggcaagaccgagggtgatcaatgcaacgaggaatttggcgaagatctggaagccgttgatcattttttccgggatgaatttcagccccagcgccaccagcaccgcaacgataagtaccgggatcatgttcatcaggatcagcgcaaaggtgaattcaacaggctggccgttgatctgcacaccggagtacatcgctaccagaccaccagcgatacagccaatcggaatggtcactatgcccgccagcacgccgagcgccagataacgacggtcagaaggttcgataatgccgagcgccaccggaatggaaaacacaatcgttggccccatcatcgacccgagaattaacccagagtatagccacgctgctacgtcaccgcccgccagctctttggcgaggaagaagccgcccatatcgcacgccagcagtgttccggcgaacattgacgggtttgcgccgagcatttcgtaaaccgggataatcaccggcccgagtacgtgggccagtaccggtgccagcgcggtcataccgaccatcgccaggcccagtgcgcccattgccataaagccttcttcaaactggccgccggccccttcgatacttttgccgaacttaccgaggaaacgagcagaaccgccgaactgcgacaggatcctgtctacggcagctatcagcataaagaacatcatgatgtacatgatgatttcgttaattcccatcgcctttactccctgttagttgttatttattggcggatgcggcgtgaacgccttatccgccctacatgtgcaatcccgaaggccagataagacgcggcaagcgtcgcatccggcaattgcaccgcgccactggcggatgcggcgtgaacgccttatccgccctacatgtgcaatcccgtaggccggataagacgcggcaagcgtcgcatccggcatttattgcgccgctgcgtacaggccgacaatctgctccaggctggcggtacgcgggttgctgcgcagacaaatatcttcctgcgcggcctgcgcccatgcaccgtaatgcccggttgttgcacccacatcagccagccgcttgttgatcccaacttccgctatcagctcacttaccgcattaatagcgtcacgatcgtcggattttttagttcgcagcgcccgaccaatctgactaaaccgatcacgacaaaccatccggttaaactccatcaccgttggcagcaacatggcgttcgccagaccgtgcggaatatgcagcgccgcccctggctgatgcgccatcgcgtggcataacccaagcccggcgctggaaaacgccattcccgccatacatgaagccagcaacatgctctcgcgcgcggcaaggtcatggccgtagcccaccgctttcggcagtgatttgccaatcatcgcaatggcaccaatcgccaggctgtcggtaaacggtgtagcgttcagcgcgctgtacgcttcaatggcatgggttaacgcatcaatgccagtcatcgccgtgacatgcgacggcacgccttcggtcagcacagcgtcgagaatcgccacatccggcatcagcgaggcgtgggctaacacctgtttgcgcccgcttaccgcatcgataatcaccgtcacgttagtcgtttcagagccggttccggcggtcgttggaatggcaatcaacggcaggcgcggttgcagaacgctggtttctgacatttctgccagcgtgctatccgggttcgtcaccagcaacgccacggctttcgccgcatccagcaccgagccgccgccaaacgcgatcaccccgtcacaacctgattcacgcaactgcgccacggctgcacacacgtcggtgatgcacggttcgcccaccggacatggccagagcgtcatggcgatacctttaacggccaggctacgtgtcagcccggcggtcatccctgcctgatgcaaaaagctgtctgccatcacgaacagatgtttcaacccacgcgtttgcgcttgctgcccgcaactgctcaccgtgcccggaccgcaaagcgtcaccggtggaacgctaaatgtttttacccgttgcagattcagggtatcgaacgcctgaaaaagcgccgtttgcaattcactttgcatagatcccctccgctttctctcgcccactactggcgattgccagcggggtcataaacaaactgtgctgcggtaaatgcacctgtaacgccggaaattgtttgcaaaacagcgccgctacgcccggttgcatacaggaaccgcccgccagccataaatccgtaatgccctgcccttcaatatgccgggccacaatgtccgccattttttcgtacaccggtttcaccgcgggccaaatctcgtcaccgtgaccgcgtttgtactgctctgcctcttccagcgaaatacggcgatttccggcgagagtcagagagatgtgatgtccgccggtggcttcatccgccgagtacgtcactttgccctttttcacgatggcaatgccggtagtgccgccgccgatatccactacaccggcgttgtccagttgcagcagatccgcaactgcggttggctcatccagcacatggctcacttccagtccagcagactccagcacgttgatggaaatacgcggatccgtaccaggaggaaatgaggtcgccgcatggctaaaacggcgaccgaattgctgctcaagggtgtcgagatggcgacgaacaatggtgaccgcaccgaagaaatcccagacgatgccgtcgcggaccacatcggcccagtcgaggcataccgccaccggctgaccgtcgcggtcgacaaccatcgacaccacatcgcaagtgcccagatccacccccagccacagcggagattccgtcgcggcaggcgtctggttacacagcgttgccgccgtttgcagacgtggggtgagccattgttcatcgtgcgccatcggttactccttaaacaatgcgaaacgcatcgactaatacacagcgacgcagacggacaaacgtccgcgcgctggttaccccttcaccggttggcgtggtgatggtcatcgtggtccagccttccccgcccagccccagcccggcaatacacggtccgttcttaacgaaaatgctggtatcaatggcgttcgccatctggttcatgttttcgatattgcgcgagtgcattgccgccgtgtggtggcaaccgccttccagtttcaccgccagcgcaatggcatccgccacgttggcgacgcgcacgacgggcagcaccggcatcatcagttcggtcacggcaaacggatgttctgcggtagtttctacaaacagcagtcgcgtttgttccggaactttaaggtcgattgccgccgcgattttcgccgcatcgcgaccaacccagtcacggctgacggtgccttttccgcactcgtcgatatttttcagcaacaccgattgcagttgctgcgcctgctctgcggtcagtttcaccgcatgctggccttccatcagacgcatcagttcatcggctacgctatccacaacaatcagtaccttttcgtcggcacaaatgatgttgttatcgaaagacgcgcctttgacgatggactgagcagcacgggcgaggtcggcggtttcatccaccactaccggcgggttgccagcgcctgcggcaatcagacgtttattggtgtgtttacgcgccgcttccactaccgcttcgccgccggtcaccaccagcaggccgatacccggaaacttgaacaagcgttgcgcggtttcgatatccggatttgctacggtaaccagtaagttttccggcccgcctgcggcaacaatcgcctggttgagcagcgtaatcgcccgctgggagacttttttcgccgccggatgcggggcaaaaatgacgctgttgcccgcggcaatcaggctgatggcgttgttaattacggttgccgccgggttagtggaaggcgtcaccgaagccaccacgccccagggtgcgttttcaattagggtcaggccgttgtcgccagtcagcacttgcggagagaggcactcaacgcctggtgtgccgcgcgcctgagcgacgtttttggcaaatttatcttcaacgcgccccatgccggtttcactgacggcaagttccgctaaatctctggcgtgtttttcgcctgcttcacgaatggcagcaatggctaactggcgcattgccacgctttttaacccttgctgggcgactttggctgccgcaacggcgtcatccagggacgcgaaaacgcccatctcatgaacggcggcgggcggcgtgtcactgctttgcattttcagcagtaccgctttcaccacctgttcaatatcctgttgattcatgatgttctgccttatttgtggaaaatgacctgaccgccagacaccacctcatcgacgatgccaatcacgcacagatcgaccggtgacgtttcgcttttatgcgcctggcgggcggaactgccactcaccagtaacacccactccccggttcccgcgccaatattgtcgatggcgacggcgcattgcccgtcaggattaccttgtggatcaatcatttccaccatcagcaatttgtcatgcgccagtccgtgatggcgtacggtacaaacaatttgtccagtgacgactgccagtttcatacccgcctccgtggcgtatttcaggtaaaagctccccctaccctccgcagaaggtaaaatgaaaaaggagagagcgtgacgcccgaatcgacgtcacacagggtgattacaggttgctgctatcgcctttcaggccgatcgggaagacttcttccaggtcgccgtgcggacgcgggataacatgtacagataccagctcgccgatacgctgtgccgctgcggcacctgcatcggtcgcggctttacaggctgcaacatcaccacgaaccatggcagtacacaggccgccgccaatctgcttaacaccaaccagcttgacgcgcgcagctttaaccatcgcgtcagaagcctcaatcagtgcaaccaggccccgggtttcgatcattcctaatgcttccattgtgctttcctctttatcagggtccagaacgggaccgttcattcaaccagtgtttgtaaactgctttcgtggttcacttctgtctgacgcggcacagctgccaccagcgccagttcgataatttcctgcacgctacaaccacgagagagatcgtgcatcggcgcggcaagtccttgtatcaatggcccgacggcacgatatccgccaagtcgttgtgcgattttgtagccaatatttcctgcctccagcgacggaaaaaccatcacattagctttgccctgtaacgggctggcaggcgctttttgcgccgccacttccggcacgaaggcggcgtcaaactgcaactcgccatcgacaaccagctttggtgcgcgctcacggacgatttctgtcgcctgctggacgttggcaacgcaggggtgacgggcactaccgttgctggaaaacgacagcatcgccacgcgcggttcttctccggtgatggcgcgccaggtttcggcgctggcaagcgcgatatccgccagttgtgccgccgtcggctgcggcaccacgctgcaatcggcaaagcccaacgccggaccgctgtactgtggcagcatcaggaaaatggatgagagcgttttacagcctggctgcaagccgataatgcgtaatccggcacgcagcacattcgccgtggaagagaggttgcccgcgatacagacatccgctttaccggcgctgaccattgcggcggcgaacatcagcggatcggtaagtttttccagcgcatccggcggcgttttttcgcccgcgcgggccagccagcgatgagcaaattcttcccgcattgcgaggttgccatgcggatctatcacctgtagcccgtccatcgccacgccgtgactgagcgcaaactgacgaagttcaaacggattggcgaccagaatgggcgttgccagaccttgttgatgtaaatattgcgcagctttcagcacacgttgatctaacgcatccggaaaaactactctggcgggcgctcgcaacgccagttcacgacaacgtttaataatcattgcgtttcccccagtcgttgttggatctgcttcaccgttagcggctgcttcgttacgctcaggatcatcatcacgtagaccgtgctggaaaggcggttcagcgcctgcaaaatgtccgggcgtaatacttcaaagctgcgggtgataaagacctgcgccgctacggtttcggtttcccgcactttggtgcgtaacagatttagcaacgccgcatcgcgcccgtggctggcttccggcaccagatgatcgtggtcgagataacgcagcggctggtgagaaagccgatgcagatcttcgtcagaaagcccgacaatcgcttgatcgcccagcggttcccccagcgcatcggcacgcataatgttgccaagacgcgaacggatatccgccagccacggctgccacggttccgccagttcaatttgcagccacactgccagcgcaatggtgctgtcgagaacagcgcgaaaagccaggcgcggatcgcttttggcaaccattttttccgccgacaggtgagtcagcgtatccggcttttttgccaccggctggcggcacagttcgcagcacgcctgcggatgttcatcgctactggtcagcccgtgaacgggctgcggctgctgctgttcatcgtcaacaaacaggcggccctgctcgtcaataaacttgatgcgcagatggcggctttccagtaactcccgggcagagggcgtcaggcgactgtccgcagggagatggatctctgcgccttcgctgagcgtatggttcgctcttagccatgcttcggtgataaaatctttcatagggattgccagttagccggccaggcgacatacaggaatttcacgctggatgtcgtaccaaattcgatgctggagcctttcgggataaacatcacatcgcccgctttggcgatcatagtttcgccttcgtggcgaacatgcagctccccttccagcaccatgtcgatttcgtcgtagttcagggtccacggaaagaaggcgttctcccactgcatgaaaccagcggccatactgctgccgtcgtctccggtcacgagatcagtcaagcctacgcagtgcggttccgcgccatcgaaacgaccaaacttgacgctgctgccatcaataactttgatgccgcctttgccggtcaccgatttaaagctcggctgcagtgcaccctgttccagcgactgtttttccttcatcactttttccatcagctgcgcgaccaggctttcggtaaactgaccttccggcagttgggcgataatggtttcacggatgcgctggctttcggttttatcggctgatgcgctggcgggaacagacgccgttaccgggatcgattcatcacattcggtgatggtaaaacccaacagatcagccacttcacgagcttccggggtaataatgctggcgcgcagaaccacggacattgccagttcgccgcgcgcgtgtgcttcacgaatatcattcgctgtgatgagttttttcacctgcttcctcctgtttggtgagagatgccagataatccaccagttgctgcacgctttgcgggtcgtggctgtttagctcgaaaatcggctcttcgaagcccgtctcaagcaataactttcgcgttgcggcgacgtcagcatctggcatgtccgttttactgatgacggcgatttgccgtttgctgacgccaatatccagcaacccggcaggcaaccgactttccgggtcattcgcgccgtggacatagatcagcatgtccacatcctgtagcgtggtaattaaggcgtgataccagcggggatggctaaaatattcacccggcgtatcaatatcgccattatcattaaattccacggtctgtgtttttcttgcgagggtataattcccctgcaacgcattaaataacgttgtttttcctgccccgacggtacccacaaacgcaattcgtttcatgaatgcctcgtattaacttttggtcatttcacaaagcgtataatttaataagcgtcctaaaccactgacggtttgtgataacgcttcttctactgcgcccaccgagccataaatcaccagcgcgccgctaaaacggtcgagaaaaccgatatgcacatcggcggctttcaacgctaaatcaccggcgatcatcgccgtttctccgggagttagcgtcataatgccgattgcgcccgcatccggaacgccgattttcttcgccagttcctcgccgggatgcgcgatgagatgcgccagtgtgacctgtttaccgggcacaaattcctgaatgatgcgttctttatccatgagtcgccgcctgtgaaaaactttcgtgtatcgtgacaatttttcgtcagagtaaataacaaaattcggcaagcgcgtttaaaaggtgaggtagatcactaagaatggagagatatttgatgtggtgcataaactttcatatgcaacgcatgaatataaataaaataatatcgagatattttatatactgatttttttattattcgcaaactcagtaataaactttactaatatattgcagctaaaccgcttaccctgaatattcagggtaagcgtgagagttaaaaaagaattacagcggttgggtttgcgcttcaaccacggccagcgccaccatgttgacgatacgacgtaccgatgcaatcggcgttaacacgtgaaccggtttcgccacgcccatcagcaccggaccgacagtcacaccttccgagctggaaacgcgcagtaagttgtaactaatgcgggcagcttccatgttcggcatcaccagaatattagcggaacctttcaaagggctgtccggcatacggtcgttgcgaatcgcttccaccagcgctgcatcgccgtgcatttcaccatcaatcatcagttctggcgcacgttccctgaccagttccagcgcctgacgcattttgctcgacgacgggcagtcagaagaaccaaagttggagtgcgacaacaaagccacacgcggctcaataccaaaacgacgaacagtttctgccgccatcaaggtgatctccgccagctcttctgcatcaggctcatcattgacgtaggtatcggcaataaaggtgttaccactcggcaacagcagcgcgttcattgcacctgcggtgtgaacgccatcgcgataaccaaagacatttttcaccacgctaaagtgttcatgataatcgcccaccgtaccgcaaatcattgcatcggcttcgccacgctgaaccatgatcgcgccgatcactgtcgggttactgatcagcgcacgctgcgcctgctcctgagtgacaccgcgacgcttcatgatctggaagtattcggtccagtactctttaaagcgcggatcggattcgttattgacgatctcaaaaccaacgcccgccttgatctgcaagcccagtttctgaatgcgcatttcgatcacgttcggacgaccaataaggatcggtttcgccagtcccagagtcaccagttcctgagtcgcgtgcagaacgcgcgcctcttccccttccggcagaactacgcgcttcggcgctttgcgagcctgggagaaaatcggcttcataaacaggttggttttgtaaacgaactccgtcagcttgtcgatgtagacgtcgaaatcagcaatcggacgcgtcgccacgcccgactccatcgccgctttcgccaccgcaggagcgatcttaacgatcaagcgcggatcaaacggttttggaatgatgtattccggaccaaagctcagatcctgatcgccatacgctgaagccaccacttcactctgttccgcatgggccagttctgcaattgcacgtactgccgccagtttcatctcttcgttgatggcggttgcgccaacgtccagcgcgccacggaagataaacgggaagcaaaggacgttgttcacctggttcgggtagtcggaacggccggtacagatgatggcatccggacgcacttctttcgccagcggcggcagaatttccggttccgggttcgccagcgccaggatcattggcgcacgggccattttcttcaccatttcctgggtcagcactttcgggccggaacagccgaggaaaatatccgcgccttcaatcacatcatcgagggtacgtttaccgtcatccaccaccgcgtatgcggctttggtttccgccatgtttggctcacggccctgatagataacgccttttgaatcgcaaaccacgatgttatgtttttgcagacccagcgctaccagcaggttcatacaggcgattgctgcggcacccgcgccagaaaccaccatccgcacgtcggagatgtttttctccaccacgcgcaagccgttgaggatggcggcagtgctgataattgccgtgccgtgctgatcgtcgtggaataccggaatattcatccgctcgcgcagtttctgttcaatatagaaacattctggcgctttaatgtcttcgaggttgatgccgccgaaggtcggttcgagcgcagcgacgacttcaataaatttgtccgggtcgagttcatcaacttcaatgtcaaatacatcaatcccggcgaatttcttaaacagaacgcccttgccttccatcaccggtttgcctgccagcgcgccaatgttgcctaaccccagcaccgccgtaccgttagagatcaccgctaccaggttaccgcgcgcggtatatttgtaggcttttaacgggtctttttcgatttcaagacaaggtgcggcaacgcctggtgagtaggccagcgccagatcgcgctgcgttgccagaggcttggttggagaaacctggattttccctggaactggaaattcatggaaatcaagtgcactttgttttaactggtcatccatttggttgttcctttcacgtaacgttcacaaataaagtgtgtgggcaacagcccctgtccacaacgtggcgcacattattaccctgccggagtctacagactttgagcaagtccaaactctcaccattaatataatgttttggtaataatcctataacactgatgttacctgcttaatccagcaataccatgcctgtctgctatgcttttttgatgcgtttagcgaaatttctcagaagtgtgaattaacgcactcatctaacactttacttttcaaggagtatttcctatgaacgagttagacggcatcaaacagttcaccactgtcgtggcagacagcggcgatattgagtccattcgccattatcatccccaggatgccaccaccaatccttcgctgttactcaaggctgccggattatcacaatatgagcatttaatagacgatgctatcgcctggggtaaaaaaaatggcaagacccaggaacaacaggtggtcgcagcgtgtgacaaactggcggtcaatttcggtgctgaaattctcaaaatcgtacccggtcgcgtgtcaacagaagttgatgcacgcctctcttttgataaagaaaagagtattgagaaggcgcgccatctggtggacttgtatcagcaacaaggcgttgagaaatcgcgcattctgatcaagctggcttcgacctgggaaggaattcgcgcggcagaagagctggaaaaagaaggtatcaactgcaacctgacgctgctgttttcttttgcacaggcgcgggcctgtgcagaagcaggcgtttttctgatttcgccgtttgtcgggcgtatttatgactggtatcaggcacgcaagccgatagacccgtatgtggtggaagaagatccaggcgttaaatcagtacgcaatatctacgactactataagcaacaccactatgaaaccattgtgatgggcgcgagcttccgtcgcaccgaacaaatcctcgccttaaccggctgcgaccgactgactatcgcaccgaatttgctgaaggagctacaggaaaaagtttcgccagtggtacgtaaattaatcccaccttctcagacgttcccacgcccagctcccatgagcgaagcggaattccgttgggagcacaatcaggatgcgatggcggtagaaaaactgtctgaaggcattcgtctgttcgccgttgatcaacgcaaactggaagatcttcttgccgccaaactataaaccagccacggagtgttatatgtcccgaaaagaccttgccaatgcgattcgcgcactcagtatggatgcggtacaaaaagccaattctggtcatcccggcgcgccgatgggcatggctgatattgccgaagtgctgtggaacgattttcttaaacataaccccaccgacccaacctggtatgaccgtgaccgctttattctttccaacggtcacgcgtcgatgctgctctacagtttgctgcatctgaccggttacgacctgccactggaagaactgaagaacttccgtcagttgcattcgaaaacccctggtcacccggaaatcggctatacgccaggtgttgaaaccaccaccggtcctcttggacaaggtttggcgaacgccgtcgggctggcgatagcagagcgtacgctggcggcgcagtttaatcagccggatcatgaaattgtcgatcacttcacctatgtgtttatgggcgacggctgcctgatggaaggtatctctcacgaagtctgttcgctggcgggcacgctggggctgggcaagctgattggtttttacgatcacaacggtatttccatcgacggtgaaaccgaaggctggtttaccgacgatacggcaaaacgatttgaagcctatcactggcatgtggtccacgagatcgacggccacgatccgcaggcggtgaaggaagcgatccttgaagcgcaaagcgtgaaagataagccgtcgctgattatctgccgtacggtgattggctttggttcgccgaataaagcaggtaaggaagaggcgcacggcgcaccactgggggaagaagaagtggcgctggcacggcaaaaactgggctggcaccatccgccatttgagatccctaaagagatttatcacgcctgggatgcccgtgaaaaaggcgaaaaagcgcagcagagctggaatgagaagtttgccgcctataaaaaggctcatccgcaactggcagaagagtttacccgtcggatgagcggcggtttgccgaaggactgggagaaaacgactcagaaatatatcaatgagttgcaggcgaatccggcgaaaatcgctacccgtaaggcttcgcaaaatacgcttaacgcttacgggccgatgctgcctgagttgctcggcggttcggcggatctggctcccagcaacctgaccatctggaaaggttctgtttcgctgaaggaagatccggcgggcaactacattcactacggggtgcgtgaatttggtatgaccgctatcgccaacggcatcgcgcaccacggcggctttgtgccgtataccgcgacgttcctgatgtttgttgaatacgcccgtaacgccgcgcggatggcggcactgatgaaagcgcggcagattatggtttatacccacgactcaattggtctgggcgaagatggtccgacgcaccaggctgttgagcaactggctagtctgcgcttaacgccaaatttcagcacctggcgaccgtgcgatcaggtggaagcggcggttggctggaagctggcggttgagcgccacaacggaccgacagcactgatcctctcaaggcagaatctggcacaggtagaacgaacaccggatcaggttaaagagattgctcgtggcggttatgtgctgaaagacagcggcggtaagccagatattattctgattgccaccggttcagagatggaaatcaccctgcaagcggcagagaaattagcgggagaaggtcgcaatgttcgcgtggtttccctgccctcgaccgatattttcgatgcccaggatgaggaatatcgcgagtcggtactgccttcaaatgtttctgcccgcgtggcagtagaagcgggtattgccgattactggtacaaatatgttggtctgaaaggggcaattgtcgggatgacaggttatggggaatctgctccggcggataagctgttcccgttctttggctttaccgccgagaatattgtggcaaaagcgcataaggtactgggagtgaaaggtgcctgatggtgatcgccggatgctgattgtcggatgtgacgctggtgcgtcttatccggtctacatgtccccgccattttgtttaacgggtgatccacaacgtgggccaggcgtctggcccatgccagttatcgcaggtgggttctgcggcgtaacgcaccaggcgaaaacgctgaccgtcaaagcgccagcgcgcctgaatgccacaatcgcttaatccgcgcccttttgctaaggtcaccagttcacgcgatttttcatcgaatgttgcgttcatcagttccagttcattggtctcctgaccgttgttgaacggcaaacgcaaccgtaccgggcgcgaggccagcggctttttacgcgacacaatccatgccaaatcaatggtgttataggcccctgcctcacagctaatcatcatcagcgctttatcatcggtcagcgcagtgacattcacctcacgacgtaacggatcaagcgaacagcgcagaccattcatccgccagtttccataatccagcaaatcgttacgttcttcgcgtgagagtggcgtcggcgttgggttaaccaccgcgacctctttcagcgcaggcgctggcggtacgctgagcggcggttcgtcccctttctttatccacgcggtctcactgccaacgcgcttttgctgggcatcaataaacaacaacgccgcttttaagccactcagagaaatagtctgattgccgtcgcgtaaggtgatcgccctcccttcctgaatcatctgcaaaaacgcggtgatggttgccgtatcatcggttactaataaccatggtgaaatccgccacttgtcaccacttaacgccaacggctcaccatctaacagcagccgtggcgctatctccccttctgacgcatccggcgacttcaacccgccgcgctcaatacgtaaaacggcatcggtatgcgccccggcgctgcggctcagggtcatcaccagtccattatgatcgcccgtattgcgcgctacacagaaattttgattattacaggtgacctgccagtcggaaaacgcccgttgcgctggtgccgcccacaccaaagacatcggcaacaaaacgaaaaaaaagagaaggaaaatgcgatatcgcatggacggtacgaccccagaagttcaaacaaacagcacaagtcgtatcttcgttgcgcaggtagcgcggctcaatcggatttgtcggattgagccaataataaacaacgaaatattattgttatttttcagtccattaaatgtgacatttgcaaatagttaagcaataacaccgtcttaccgtcacgtatctcgccggttttaatcatctccagcgcctggctgaacggcagctcaagcacttcaatatcttcatcttcgacaccaccaccggcgttagcgcgctggctgtcactgtattcggcgataaaaaagtggattagctcagtcacaccgcctggcgacatatacagttcaaataatttgcggacttcgccaacttcatagcccgtctcttcaatcgcttccttgcgaatgcacacttccggttcgtcgttatccagcagcccggcgcaggtttcaatcagttgcccgctttcattgccattaacccaggtagcgacgcggaactggcgaatcagaaccacggtctttttcttcgcgttgtacaggaggatcgtcgcaccattaccgcgatcgtaaacttcacgtttatggcggataacttcgccatctttgcgcgtgagatcgtaagtaatgttgtgcagggtgaaatagttatcggagagaattttgtctttaacgagggtgatttgttgcgtcataccgactccacagcgcgaaatgaacaattatcttacgctgtgaagtcgggtttgtctgcgcaggctatcagtgagatttgactgattttacgcccagccagtcaatgatcccctgtgccgcatgacgtccttctgccattgcggtaaccaccagatccgcaccacgcacggcgtcaccaccggcgaagattttcggattcgtggtctggtaacggtactggctttccacatccgcgatgatgcggccccatttgtctaccgttacaccgtgcgactccagccacggcatcccgtgcggattgaagccaaacgccataatcaccgcatcggctggcatgacaaattcactgccttccaccggcactggacgccgacgcccctgggcatccggctcgccaagacgcgtgcgcaggaaacgaatcccgcagacgtgaccttgttcattcagctcaagcgccaccggctggacgttaaattcgaagttggccccctcttcacgggcgttcttcacctctttcttcgagcctggcatgttagcttcatcacgacgataagcgcaggtgacattactcgcgccgtggcgcagcgcggtacgcacacagtccatcgcggtgtcgccgccgcccagtaccacgacgttaagtccggcggtattgataaacggctcttccggtagctcttcgagtcccatcacctgtttagtattggcgatgaggaacggcagcgcgtcataaacgcccggcgcatcttcattgggtaaacccgctttcatggaacggtaagtgcctacgccaacgaagaccgcgtcgtattgttccaaaagcgaattcaaagagacatctttacccacttcacaattgagttcgaagtgaatccccatcgcgctgaagatttcccgacggcgtgccagcagggatttatccagtttgaaagaaggaatgccgaaagtgagcaagccaccgatttctggatggcgatcgtacaccgtcaccgccacgccattgcgggtgagaacatctgcacaggccagccctgccggacccgcaccgataatcgccacccgcttgtccactttggtgacatggcttaagtcaggacgccaacctttcgccaacgcctgatctgaaatgtagcgttcaatgttaccgatagttactgcgccgtgctcatcgcgaatagtacaggcaccttcacacaaacggtcttgcgggcaaacgcgtccggtaatttccggcagggtgttggtctggtgagaaagctcgacggcggcgtcgatgtttccggctttcaccagttcaatccactgcggtatatggttatgcagcgggcaggtccattcacaaacgctgtgctcgccgcacttaaggcagcgcgaggcttcccgttgtgcctgatcggcacggaatggcagataaatttcatcaaaaccggttttgcgcgcttcaatcgccagtttatctggctcgccacgcgcgggcgttgcctgcatttgctcgactttactcattaccggcatttcttgcgccgcggtactggcatgccacggttgttgttcctgacgtgcggtgcgcaagcggcgggatttcgccatgccggagagtgcggcgtcagtgaccagttgcagcgcgtccgccgggcaattttcgacacaggcaggaccgttttcgcgccctgcacaaaggtcgcatttatgcgccgtggcttttacttttcctaccgcaacgggtgtcagaacgatttgcatcgtaccaaatggacaggccaccacgcaggatttacagccaatacacttttgctgattgacctgaatgctgtcatcaacgtggctgattgcgccattagggcagctacgggcgcagggcgcatcttcacaatggtgacaggtcactgcactacgttgctgctgatgtttgataaccgtaattcggggatgaaaatggtgttggctcaggacatgttgctcgtcattgtgagccatgacacaggcgatttcacaagcatgacaacccagacattgctgactgttggccataataaaacgattcataacgaccttcttttttggttgtaaaaaccttattctttatatgagtgttgttattacccgacttacaggggaatcggcaatgttcatgtgcccagaataagtaactatttcgctataaactgtggcagatcaaataatcccatcactgactaaatttcgtttcagcgaactggaacattaatgattttttgtggagaagacgcgtgtgattgttaaacgacccgtctcggccagtctggcccgggcctttttttacattgtgctgctgtcgattctttccacgggtatcgctctgctaacgctggcgagcagtttacgcgacgctgaggctatcaatattgccggatcgctgcgtatgcagagttaccgcctgggctacgacttgcaaagtggcagtccacaactcaatgcacatcgccagttatttcagcaggcactgcattcaccggtattaaccaatctcaacgtctggtatgtgccagaggcagtaaaaacccgctatgcgcatctgaatgccaattggctggagatgaataatcggctcagcaagggcgacttgccgtggtatcaggccaatattaataattatgttaatcagatagacctgttcgtgctggctttacagcactacgctgaacgcaaaatgctgctggtggtggcaatttccctggctggcggcatcggtattttcacgctggtcttttttactttgcgccgcatacgccatcaggtggttgccccactgaatcagctggttaccgccagtcagcgtattgaacacgggcagttcgactcgccgccgctggataccagcctgccgaatgagcttggcctgcttgcaaaaacctttaaccagatgtcgagcgagctgcataaattgtaccgttcgctggaggcgtcagtagaagaaaagacccgcgatctccacgaggccaagcgtcgtctggaggtgttgtatcagtgttcgcaggcgctaaacaccagccagattgatgtgcattgtttccgccatattttgcagattgttcgcgacaatgaagcggctgaatatctggagttaaatgtcggtgacaactggcggattagcgaagggcagccaaacccggaattgccgatgcagattttaccggtgacaatgcaagagacggtttacggcgaactgcactggcaaaatagtcacgtttcatcatcagaaccgctgcttaacagcgtttcgtcgatgctgggacgcggtttgtactttaatcaggcgcagaagcattttcagcagttattgttgatggaagaacgtgcgaccatcgcccgcgaattgcacgactcgctggctcaggtactttcttacttacgtatccagttgacgttactgaagcgttcgataccggaagataacgccaccgcacaaagtatcatggccgatttttcccaggcgttgaatgatgcttatcggcagttacgcgagctgttgactactttccgcctgacgctgcagcaggcggatctcccctccgcgttgagggaaatgctggatacgttacaaaatcaaaccagcgccaaactgaccctcgactgccgtctgccaaccctggcgctggatgcgcaaatgcaggtgcatttgttgcaaattattcgcgaagcggtgctgaatgcgatgaagcacgccaacgccagcgaaatcgccgttagctgcgtcaccgcgccggatggcaatcacacagtctatattcgcgacaacgggattggcatcggtgaaccgaaagaacccgaaggccattatggtctgaatatcatgcgcgaacgcgcggaaagattgggtgggacgctgactttttcacaaccttccggcggcggcacgttagtgagtattagctttcgctctgcggagggtgaggaaagtcagctgatgtaatgcctcttattgaccaaagaatagtggcacttaaggttcagtataaaagggcatgataatttacattaactcctttttttctccacgattggctcgtaccttgccgctacagtgaagcaagccaagcctacaacgatacgcagaaacacgaggtcctcttttaatggcgaatttctttattgatcgccccatttttgcctgggtgctggcaatcctgttgtgtctgacaggtaccctggcgattttttcattgcccgttgaacaataccccgatctcgcgccaccgaatgtgcgagtgaccgctaactatcccggcgcatcggcccagacgctggaaaacaccgtgacccaggttatcgagcaaaatatgaccggcctcgataatctgatgtatatgtcatctcagagcagcggcaccggtcaggcatctgtcacgttaagttttaaagcaggcaccgatccggacgaagccgtgcagcaagtacaaaaccagctgcaatcagccatgcgaaagttaccgcaggcggtgcaaaatcagggcgtgacggtgcgtaaaaccggcgataccaacattctgaccattgccttcgtctctaccgatggttcgatggataaacaggatattgccgattatgttgccagtaatattcaggacccgttaagccgcgtgaatggcgtcggggatatcgatgcctatggttcgcaatattccatgcgtatctggctggacccggcgaaactcaacagtttccagatgacggctaaagatgtcaccgatgccattgaatcacagaacgcgcagattgcggttgggcaacttggtggtacgccttccgtcgataagcaggcgctcaacgccactattaacgcccagtcactgctgcaaacaccagaacagttccgcgatatcaccttgcgggtgaatcaggacggctcagaggtaaggctgggcgatgtcgccaccgtcgaaatgggggcggagaaatacgattatcttagccgcttcaatggtaagccagcctccgggctgggggttaaactggcctccggcgcgaacgaaatggcgacagcggagctggtgctcaatcgtctcgacgagctggcgcagtattttccacacggactggaatacaaggtggcgtatgaaaccacctcgtttgttaaagcctccattgaagacgtggtgaaaacgcttctggaagctatcgccctggttttcctcgttatgtatctgttcctgcaaaacttccgcgccacgctgatacccactatcgccgtgccggtggtgttgatgggaaccttctccgtgctttacgccttcggttacagtgtcaacaccttaaccatgttcgcgatggtgctggcgatcggtctgctggtggatgatgccatcgtggtggtggaaaatgtcgaacgtattatgagtgaggaaggactcactcctcgcgaagccacacgtaaatcgatggggcagatccagggggcactggtcgggattgcgatggtgctttcggcggtatttgtgccaatggccttcttcggcggcaccaccggtgccatctatcgccagttctctattaccattgttgcggcgatggtgctgtcagtactggtagcgatgatcctcactcctgctctgtgtgccacgctacttaagccactgaaaaaaggtgagcatcacgggcaaaaaggcttttttgcctggtttaaccagatgtttaaccgcaactccgaacgctacgaaaaaggggtggcgaaaattctccaccgtagcctgcgctggattgtgatttatgtcctgctgcttggcggcatggtgttcctgttcctgcgtttgccgacgtcgttcttaccgctggaagaccgtggcatgtttactacctcggtacagttgcccagcggttcaacccagcaacagaccctgaaagtcgttgagcaaatcgagaaatattacttcacccatgaaaaagacaacatcatgtcggtgtttgccaccgtgggttctggccctgggggtaacgggcaaaacgtggcgcgaatgtttatccgcctgaaagactggagcgaacgcgacagtaagaccggcacctcgtttgccattatcgagcgtgcaacgaaggcgtttaacaagattaaagaagctcgcgttatcgccagcagcccgccagcaattagcggtcttggtagttctgcgggttttgatatggagttgcaggaccacgctggagcgggtcacgatgcgctgatggcagcacgaaaccagttgctggcgctggcagcggaaaacccggagctaacccgtgtgcgccataacggcctcgacgacagtccgcagttgcagattgatatcgaccagcgtaaagctcaggcgctgggcgttgctatcgacgatattaacgacacactgcaaaccgcctggggttcgagctatgtgaatgactttatggatcgcggtcgcgtgaagaaagtctatgtgcaggcagctgcgccgtatcgcatgctgccagatgacatcaatctctggtatgtccgaaataaagatggcggcatggtgcccttctctgctttcgcgacctcacgctgggagacaggctcgccgcgtctggaacgctataacggttattctgcggttgagattgttggggaagccgcaccgggggtcagtaccggtacggcgatggatattatggaatcgttagtgaagcagttgccaaacggctttggtctggagtggacggcgatgtcgtatcaggagcggctttccggcgcgcaggctccggcgctgtacgccatttccttgctggtggtattcctgtgtctggctgcgctgtatgaaagctggtcggtgccgttctcggtaatgctggtcgtgccgctgggggttatcggcgcgctgctggcaacctggatgcgcgggctggaaaacgatgtttacttccaggtgggcctgttaacggtcattggtttatcggcgaaaaacgctatcctgatcgtcgagtttgctaacgagatgaaccaaaaaggccacgacctgtttgaagcgacgctccacgcctgccgtcagcgtttacgcccgattctgatgacctcgctggcatttatcttcggcgtattgccaatggcaaccagcacaggtgccggttccggtggtcagcatgcggtgggtactggcgtaatgggcgggatgatttcggccactattctggctatttacttcgtgccgctgttctttgtgctggtgcgccgccgcttcccgctgaagccgcgcccggaataagcaataaaaaaggcgacatgccaatgtgtcgcccttttcaactttccgattaagaacctgctcagcggattcttgctgtttgtactttgtctcaggaattacttacgaagcataacttcgataaagtctttccagttccccagttcacgttcaatcataacaacctctcttataattatgggtattctacggaaacaatataccgtggtgaagctaatttactcgattgctgtgatgactacctccgggggacaaaccttatgtaaatactatggtcctgcggtgatgatttgtatgtgatgcaccgcaacatttcgagatattcatacggcatctaatactgatttaattctggttaaaatacagacagataacaagatgaatattcttaatgtttacgttaaaaatgtttaatgttatttaatggttgttaatttgaatacttcgataatgttatatttcctgataatcatttgcaggcaaaatgttttcacctttaaatgagtatttattctcataaatcgaaaaaggattcattatggttacactttacggcatcaaaaattgtgacaccattaagaaggctcgccgttggctggaagctaataacatcgactatcgttttcatgattaccgcgtcgatggattggacagcgaattattgaacggttttatcaacgaattaggctgggaagcgttactcaacacccgtggtacaacctggcgtaaactggacgaaaccacccgcaataaaatcaccgatgcggcctctgcggcgacattaatgactgaaatgcctgcaattatcaaacgtccattgctctgcgcgcctggtaagcctatgctgctgggtttcagtgaatccagttatcagcaatttttccatgaggtgtagtctatgtcgtgcccggttattgagctgacacaacagcttattcgccgcccttccctgagtcctgatgacgcaggatgccaggctttgttgattgaacgtttgcaggcgatcggttttaccgttgaacgcatggactttgccgacacgcagaatttttgggcatggcgtgggcagggtgaaacgttagcctttgccgggcataccgacgtggtgccgcctggcgacgccgaccgttggatcaatccgccgtttgaacccaccattcgtgatggcatgttattcgggcgcggtgcggcagatatgaaaggctcgctggcggcgatggtggtagcggcagaacgctttgtcgcacaacatcccaaccatacgggacgactggcatttctgatcacctctgatgaagaagccagtgcccacaacggtacggtaaaagtcgtcgaagcgttaatggcgcgtaatgagcgtctcgattactgcctggtcggcgaaccgtcgagtatcgaagtggttggtgatgtggtgaaaaatggtcgtcgcggatcgttaacctgtaaccttactattcatggcgtgcaggggcatgttgcctacccacatctggctgacaatccggtacatcgcgcagcacctttccttaatgaattagtggctattgagtgggatcagggcaatgaattcttcccggcgaccagtatgcagattgccaatattcaggcgggaacgggcagtaacaacgttattccgggtgaactgtttgtgcagtttaacttccgcttcagcaccgaactgactgatgagatgatcaaagcgcaggtacttgccctgcttgaaaaacatcaactgcgctatacggtggattggtggctttccgggcagccatttttgaccgcgcgcggtaaactggtggatgcggtcgttaacgcggttgagcactataatgaaattaaaccgcagctactgaccacaggcggaacgtccgacgggcgctttattgcccgcatgggggcgcaggtggtggaactcgggccggtcaatgccacgattcataaaattaatgaatgtgtgaacgctgccgacctgcagctacttgcccgtatgtatcaacgtatcatggaacagctcgtcgcctgatgagtggttctgcaagaggaaataagcatggactggctggctaaatattggtggattctggtgattgtctttttggtaggcgtcctgctgaacgtgattaaagatctcaagcgcgtcgaccataagaaatttctcgccaacaagccggagcttcccccgcatcgtgatttcaacgataaatgggacgatgacgacgactggccgaaaaaggatcaaccgaagaagtaagctaagtggccggataaggcgttaacgccgcatccggccatgatgcctgatacggtcttatcaggcctacccggctattattacatcatttcaatcacatcatcatcgccaggcttaccgccacttagcgcttcgtcgaaataatgtttcggaatggtataacgcaagtgatccagggctaattgcatactgcgattgtcgatcgcatggcctaaatcctccacgatatccagcgtcacatcgccaccggcactgattaacgcttcctgcgccgcaaccgcatgcgccagatcgataaccggatcttcaccgccatgaatcaagtgaattgttgtggctgtagacgctgtttccggcaggctcgcgtagcgtccgttgaaggcaatgacgcgcgaagcaaggcccggttcggctttaatgctctccagcgccataatcgcgccttgtgagaaaccgattagcgccgtggcattagcccctactccgctttgtttctgccagtagcgcaccgtctcaataaacgtcggcatgatcgcatccacacgcgcctggcgattatcttccgtaataccctgcaccgaaaaccactgacgccccgccggattaccgctcggctccgcgccaccgacactcactaccagcgcatcaggaaacagcggcgcaaaccagctacctatttcccccattgccaccgggttatccccgacaccgtggaaaagcagtaacaactgttgtgctggtttatccgggctttgaacaacaaaatggtcatgtttcatggcgaactccttaactgatgtcattaattttacgccgctgactcacaatgactatgggagaaaattgaaggagtcagtgaaaaaattgccattgcgttatgcgatcgcgcagacgctcagtgcaaacatcatcaagtgcgaatagcgcctgcgcggcttcttcgcgttgacggaccagtaacagcttacggcctgaaagtttaagtgtggtacataactgcgcgtcactggcgtttttctgtaaacgcccacgcagcgccggtaatgccagttcgctggtttgtaacagacgcattaagcaacctaacgacgttaatagcggacgatgagcgaaagcaaaaccggccagttcaagccagtcgtcgtcagaaaggacggcatcgtttagtggatcaacaggaagcatttcgccattccactgcgcgagagcttgcgcatcgcgacgtaaacggtaatgctcacgttcagccagctgtttacccgcatcactcatcggtaacagcgccatcgccgtatagcaaccgctgctggcttcacgatgattacccattcgcaccagcacaaaaccgcagcgttgccagaaacgccataactcctcggtgtaaccaaaactcaccgaaagatagtcgaggtcatgaatatattgcaaagcaccagcaataagctgtcgccctgtgccttcccgctgacgagccggatgaactgctatccggctaacccgccgtccgcgcaatgtcgccgccagtggattgctgccgtgcgccgccagcgattgagccaccagattgccccgtggacgacgataacccgcccataccgcctgactgagttcttgagataatccaccctcatccaccagacacagcgctccggcaatctcgttttcgccagccgcctgtaaaaaatgttgacctggtgcatccatcatgcggcgtaaatccagcggcgaagtccggtagtgcgcaccagacaataattgataaacctttaacggcgtttctggctcgcttcgccataacgtctgttcaaatgcggaaataacgatattgccttgtggtgtatgggtgaagttttcatcgtcaaaaaccagtgcctcactaaccattttttccagcgggcatccctgcgcccaacggatcggctgttgtagttcaaaacggtgtaaatgcggaaagcgagcgcaaaatttcagcaaaaaaccacgtccggtgccttcgtagccctgcaccgtagtagttaacaacgttcgaggaaaacgcgataccagttgatacaacaacggcgcaggtatagctgcggcttcatcgaccaccagccagtcggcttgctcatcgctggctaacaaggcatccggcgcaataaagcgaaacttctcgcccgcaaattgtgccagtacatccgttgccgcttttgcgggcgcggtgacaatcgcactgcccgcaatacgagaaatgagttgccctgccaacgccgacttaccgcgcccacgcgcagcagttaccgctgccacgcccggcggcatggtcagtagctgctgtaagagttgctgttgttctggttgtggtgcgccggtagcggggtgccagtcagtacggggagtaaaatgcgccaacgagaacggctggttttgccgccagaggatagcgtcgttattcgccgtaagtacgcgtttgaaatgctggacaaaatgcggcgtcgcaatagggtcagggcaatcactccagcgcagcgagtcggcatcaggttggttttcccactcttcccatacagggagtaacaaaaccagccaacttcccgctttcaacgttccgctaagtgccgcaaaggcagcggcatcaaagccgtggcgggcgtcgaataccgcatgccggaactcgcgcccaagtaaagtttgtagcgccgagggtgaacagtggttttcagcatctggctgcggcgaaatccacagccagtcgccaggtaaggcatcacgcaacttaagcgcatgatcaaaacaccaaccctcttccccgctcaacaccagcaagcggcggatcccttcacgtttcatttgcgctgttaatgtgtgaagcgcagtcagttcagccatccctgccccggaagttaaatgcttttaccaaaagtattgcattgtgccggatcgccgctgtcgaaaccacgtttaaaccagctatagcgttgctgagaagtgccatgagtgaaactgtctggtactactcgcccctgactttgctgttgtaaacggtcatcgccgatggcctgcgccgcgttcagcgcctcttccagatcgccggtttccagaacaccttgctgctgcatactatgcccccagacaccggcaaaacagtcggcctggagttccatacgcacagataagcggtttacttccgcctgcgtcgcgttttgttgcagttgacgaactttcggctcgatgcctaacagtttctgcacatgatgaccgacttcatgagcgataacgtacccctgggcaaaatcgccatccgcgccaagtttgtctttcatgtcatcatagaaggagagatcgatataaactgtgccatccgccgggcaatagaatggccccattatggactggcccgccccgcagccggtacgcgtcattccacggtacatgaccagcttcggttgctgataggttttacccatcttctcgaattgctgtccccaggtgtcttccgtggttgccagaatcaccgaggtgaattttgcggcttcgtcttcattagggctaattgaccgcgttgattgctgttgggaaaccggctgtccggtcatcaacccggtaaaatcaacgccatagtagcctgcaaccagcacgactatcagtaaaatcagcccgcctttaccgcttggcaggcgaaaaccgggaccgcccattgacggaccgccggagctattgcgcctgtcttcaacattgtcactttcacgtcgcccttgccaacgcatagatacctcaacattatattcattatagaaatgatcgtaggtggttcagaggaagattaccacaggaaagcgggatgaaatggcggaggaatgagcgttcaatactcatcttatgagagcggttgtcttgccgtgccagtagcacggcaagatgatgaatagaaaaatcagtccagctgtacacccaggcggcgggcaacggcttcataggcttcgatcaggccaccgaggctctggcggaaacggtctttatccattttctccagcgtttctttgtcccacaggcggctgccgtccggggagaactcatcgcccagaaccacttcgcctttgtacagaccaaactccagcttgaagtcgaccagaatcagacctgcatcatcgaacagttttttcagcacgtcgttcgctttgtaggtcagctctttcatacgcgccagattctctttgctcacccagccaaaggtttcgcagtaagattcgttgaccatcggatcgtgcatggcgtcatttttcaggaacagatcgaacagtggcgggttcagctcaataccttcttcgattccaagacgtttcaccagagagccagcagcacggttacgcacgacacactcaaccggcaccatatccagctttttcaccagacattcggtatcggagagcagacgctccatttgagtcgggatacccgcttcagccagtttgctcataatgaagtagttgaacttgttgttcaccatacctttgcgatcaaactgctcaatgcgcgcgccatcccctgctgacgtatcattgcggaattcgagcaccaacaggtccgggttttccgtgctgtatacggttttcgctttaccacgatacaactcagcttgcttttgcatctttatcactcctgggtgtgaattaacgttttaaaatcttttgctgtctggtgtgccggatgttttgtcggatgcggcgtgaacgccttatccgacctacgtccgacaaacaaatttcgtgcgaattaccgctaaaatcgcgtttttctgtcgacgcacacgtttgcgtatcatatcagaaaaaagggctggatgactccagccctgtatttttacttgctaaacgcagcctggaagacagctaccagcgcgtcgttctgactctgagtcagagtatgacctttcggatcgatgaactgtaggctgctgcggttatctaaatcgccaacctgcagtttatagtcaccggatgccagacctggatcgctcgcacccagttcgtgccattcgctgtcagacagcggcttataagttacggccatgttgccctgcgaacgggtgctgtcggtcactttcatgcccactttttccagcgcagctggcagacgttgccaaaccacattgaacggcccgcgtacgaccagcattggtaaaccggtgtcatcagctgcactttgtacgtccatagtggtggaggcacggttttgcgcagcgttcgcggcgtcagtggcagatttatccagaccggcggaaataacgttcatcatctccgtgctgtaacgctgcatggaagccgcgtctgcaaccggtttgcccgcctgttccaggttcagcagtttaaccgtaaccgcctgctgataaccctgcggcttaacagagatttgataacgaccacgatactgctcgtcttcgtccagacggttccattgtacccaatcggtggtcagtgtctgaccaacatcatcacgttgggtgatggtgtagtttttcgcctgcagcacgctaaccacctgcggccacagagtattgccacgaccattttccaccagcaatgaagcggtatcgcccgtgaactgggtacgcgcgccagaaaccagtgccaacggctgggctggtggacgaatgtccagcgccttaccgacagcaccactaccgttggtcaccgggattgcataatcgccggaggtcaccggcaaaatcattccagccggggcatgaagctccgcaagcggtgccgcttccaggtaggcttcatcaccactgacctgacgcttatagcgtgagtcagaactacaggcagcgagtaataaaacaagcgaaacacccgcaacctttgccaggcgcgacttttgaacagagtaagccatcaaatctccctaaactttacagcaaaccggcatgcttaagcgccgctctgaccgtctcacgaccactgtcggtgattggtgtcattggcaggcgcagcgtatcggtcgccacaagacccagttccttacatgcccatttcaccgggattggattgggttcgacaaatagtttgttgtgtaatggcatcagacgctgattaataacgcgtgcctcggcaaaatgcccttctgctgccagtttgcacatctgggccatatcacgcgctgcgacgttagccgtaacggaaataaccccatgaccgcctaattgcatgaagtccagcgcgctcgcatcatcgccgctcagcagaacaaaatcatctgaaaccagctctttgatctggtttacacgcgttaagttccctgttgcctctttgattccgataatattttttactttcgccagacggcccaccgtttccgggagcagatcgcagccagtacgggacggcacattatacagaatttgcggcaggtcagtatgttcagcgatggctttgaaatgctgatacaaaccttcttgcgacggacgattgtagtaaggggttaccgtcaggcagccgacgataccgctgtcattgaagcgctgcgtcaggctaatggcttccgcagtagcgttagcaccggtcccggcaatcaccggaatgcgcccgtcagccagctccagcgtcatcatcaccacatcagcatgttcgtcatgatttaaggtagcggactcgccagtggtgccaacagaaacgatcgccgaagtaccgctggcgacatgataatcaatcagttttttcaagctagcccgacagacattacctttttcatccatcggagtaacaatcgcgacaatacttcccgtgaacatgggccatcctctgtgcaaacaagtgtctcaatggtacgtttggtatggcattaaaagcaagcagacagaaccgttctgattgttgtatgcatgttttttttatgctttccttaagaacaactcaccccttgaaggaataaccagtttgacactgtcatcgcaacattatctggtgatcactgcgttgggtgccgatcgccctggaatagtgaacaccatcacccgtcatgtcagtagttgcggctgtaatattgaagacagtcgcctggcgatgctgggagaagagttcacgtttatcatgctgctttccggttcatggaatgccattactctgattgaatcaacgttaccgttgaaaggtgccgagctggatcttttaatcgtgatgaagcgcacgacggcgcgtccgcgtccgccaatgccagcatctgtctgggttcaggtcgatgtggcagactccccgcatttaattgaacgcttcacagcacttttcgacgcgcatcatatgaacattgcggagctggtgtcgcgcacgcaacctgctgaaaatgaacgggctgcgcagttgcatattcagataactgcccacagccccgcatctgcggacgcagcaaatattgagcaagcgttcaaagccctatgtacagaactcaatgcacaaggcagtattaacgtcgtcaattattcccaacatgatgaacaggatggagttaagtaatgaatccactgaaagccggtgatatcgcaccgaaatttagcttgccggatcaagacggagaacaagttaatttgaccgacttccagggacagcgtgttctggtttatttctacccgaaagccatgacccccggctgtaccgtacaggcctgcggcttacgcgataacatggatgagttgaaaaaagcgggcgttgatgtgctgggtatcagcaccgataaacccgaaaaactctcccgttttgcggaaaaagagctgcttaactttacgctcctgtctgatgaggaccaccaggtgtgcgaacaattcggcgtctggggtgaaaagtccttcatgggcaaaacctacgatggtattcatcgcatcagcttcctgattgacgctgatggcaaaatcgaacatgtctttgacgatttcaaaaccagcaatcaccacgacgttgtgctgaactggctgaaagaacacgcctgattactttgctccattccgtgctggctgcgcttgcggccagcacatctcaaatcttctcactgccctgcaacactcgtttcaaattttttcgctgaaggtcagtcttgcgcgatttgcccatcaggccaggcgtgaatcacggctttgatcagcgtcgccaatggaatagcgaagaatacgccccagaatccccacaaaccaccgaagatcaccaccgataaaataatcaccagaggatgcaggttaaccgcttcggagaacaacaccggtactaacaggttgccgtccagcgcctgaataatcagatacaccgcgaagcagctccagaattccgtgccagcaccaaactggaatagcgccacgccaaccaccggaatggtcaccacaaatgcgccaatgtacggaataagtaccgagaagccgaccagcaccgccagcagcagcgaatagttcagcccaaagagcaagaaccccagccaggtggcgatccctaccacgatcatctccagcactttgccgcggatatagttggtgatttgttgattcatctccttccacacctgtcctgccagtccacggttgcgcggcagcacccggcgaacggcgttcagcatctgctctttgtctttcagcaggaagaagaccatcaatggcaccagcaccagatagacggcaatggtcagcaaaccaaccaacgaagcgagggaaattttcaccaccgaatcgcccatggtcagcatcctactgcgcatattttcagccattgcatcaataatgcccgcatccattaacgccggatagcggcgcggcaacgtggcggcaaagtcagaaagcttattgagcatccccggcatatcgcggattaagtagatgccctgctgccaggcgataggcagtaccacgaacgccatcagtagcaggatgcccacaaacaggatcagcacgatagatgtcgcccaagggcgggaacagccaatagactgcaggcggacagtcggccattccagtaaataggccagcacaatagccaccagcaacggcgcgagtaggccgctaaagaaaaagataatgccaaaaccagcaaccaaaataaccagcaaggcaatcgcttccgggtcgctaaaacggcggcgataccattgcatcaacatttcgagcatacagaccttccctgaacctcaagagcgggattgcgatccgcaattgtatcgaaatgtcacaaaaaagacttcgctttttatgacggattcaggaaactgaaaagtcatttgagtgggctaatcttcgccgttacactcaaaggcggcgcggtgggaacgatatttcacagtatcggtcaaatgactatctccagaaatacaggatagaggttatgttcaggcagttgaaaaaaaacctggttgcaaccctcattgctgctatgaccattggtcaggtagccccggcgtttgccgacagcgcagacaccttgccggatatgggaacctccgcaggaagcacactttccattggtcaggaaatgcagatgggcgactattatgtccgccagttacgcggcagcgcgccgttaattaatgatccgctgttaacgcaatacattaattcgctaggaatgcgtctggtttcgcatgccaattcggttaagacaccgtttcatttctttctgatcaacaacgacgaaattaacgcctttgctttctttggcggcaacgtggtgctgcactctgccctgttccgttattccgataacgaaagtcaactggcttcagttatggcgcacgaaatctcccacgtcacccaacgtcacctggcgcgagcgatggaagatcagcagcgcagcgcgccgctgacctgggtcggcgcgttaggttctattttactggcgatggccagtccgcaggcggggatggcggcgctgaccggtacactggcgggaacgcgccaggggatgatcagtttcacccagcaaaatgaacaggaagcggaccgcattggtattcaggtgctgcaacgctcgggattcgatccgcaggcgatgccgaccttcctcgaaaaattactcgatcaggcgcgttactcttcgcgtccgccggaaattttattgactcacccgttgccggaaagtcgtctggcagatgcccgcaaccgtgctaatcagatgcgcccgatggtggtgcagtcgtcggaagatttctatctggcgaaagcgcgcacactggggatgtataattccggacgtaaccagctcaccagtgatttgctggatgaatgggcgaaaggaaacgttcgtcagcaacgagcggcgcaatatggtcgtgctttacaggcgatggaagccaataaatacgacgaggcgcgtaaaacgctgcaaccgttactggcggcagaacctggcaacgcatggtatctcgatctggctaccgatatcgatcttgggcaaaacaaagccaatgacgctatcaatcgcctgaaaaatgcccgcgatttgcgcaccaatccggtgttgcagctcaacctggcgaacgcttatctgcaaggggggcaaccacaggaagcggccaatattctgaatcgctacacttttaacaataaagatgacagcaacggctgggatttactggcacaggcggaagccgcactaaataaccgcgatcaggaactggctgcgcgagcagaaggttatgcgctcgccgggcgactcgatcaggctatttccttgttgagtagcgccagttcgcaggtgaaattaggcagcctgcaacaagcgcgttacgatgcgcgcatcgaccagttgcgccagctgcaggaacgctttaagccttataccaagatgtaattcgcattaaaggaagaacaatgaccaaacaggcaaaaatctaccataacccacgctgttcaaagagccgggaaacgctgaacctgctgaaagaaaacggcgtggagccagaagtggtgctctaccttgagacacccgccgatgcggcaacgctgcgtgatttgctgaaaatgctggggatgaatagcgctcgtgaattgatgcgccaaaaagaggatctttataaagaactgaacctggctgacagttcgcttagcgaagaggtgctgattcaggcgatggtagagaatccgaagctaatggaacgcccgattgtggtcgcgaatggcaaagcgcggattggtcgtccaccggagcaggtactggaaatcgtgggttaagatgtgctccatcgctagttgaagcacattgccggatgcgacgcttgccgcgtcttatccggcctacgaatactatggattaacttcgcgtaggtcggataaggcgttcgcgccgcatccgacaataaacaccttatctacaacttcagaatttctttcacaaaaggaatggtcagcttgcgttgcgcggtaatcgacgcacgatccagctgatccagcgtcataaacaacgtgcgcatttctctgtcgagccgcttcagcaagaaacgccccacatcttccggcagttcaaaaccacgcaaacgcgcgcgtaactgtagcgcctgcaacttatcttcatcagaaagtggctgcaatttgtagatctgcccccagtcgagacgcgacgcgagatccggtaatcccagattcaactgccgcggtggacgatcgccggtgatcaacaaccgtgttttgcccgattccagaattcgattgtagagatcgaaaatcgccatctcccacaactcatcgccggcaatacactcaatgttgtcaatacagaccagcgacaaatgctccataccgtcgagcacttccggaacaaaccaggtgcgtttatccagcgggacatagcccaccgcatcgccacgctgtgacaattccgcgcaagccgcgtgcagcagatggctgcgccccgcgccttcgcgtgcccagagatagatgtaaccgctatgttcctgacgcagcacgttttgcagcgcggccagtaaagaggagttatcccccggccagaaacttgcaaaggtttcgtcgtcaggaagataaagtggcaaagagagctgtgccggtgtgttcagagatacctcaaccaggatttcacaaaatcgcgagaagtttaccacagaatcccatgatgtttgaaccgggcagcaacactgcccggtcggtacattatttgtctgttatatccgcgtcttctgcgtccagcaccacttcttcagggcgcagcatactaatcagtttgaagatcaaacttaagccgataccgatgatggtcgccagcgccatacctttcagctccgccgcgccaatgtttaccttcgcaccactgacgccgatgatcaaaataacggaagtcaggatcaggttctgtgctttgttgtaatccactttcgattcgatcaacacacgaataccggaagcaccgatgaccccgtaaagcagcagcgaaacgccgcccatcaccggcaatggaatcatctggatagcagcagccagtttaccgacgcaggaaagcaggatagcgaaaatcgccgcaccgccgataacccaggtactgtaaacacgggtgatcgccatcacaccgatgttttccccataggtggtgtttggtgtggaaccaaagaaaccggagatcacggtcgacaagccgttagcaaacatcgaacggtgcagacctggatcgcgcagcagatcttttttgacgatattagccgttacgaccaggtgccctacgtgttcggcaataaccactaacgccgctggcagaatagtcagaatggcaaaccactcgaagcgcggcgtatagagggtcggcagcgcaaaccagtgagcattaataatcggcgtggtatcgacaattcccattgcgaaagagagcgcgtaccccaccagcacgccaattaaaatcgggataattgctaggaaaccacgaaacagcacggaacctaaaaccgtgaccgccagggtggtaatagagatgatgatggttttggagtctggcgtttgcccttcagccgggagtaaacccgccataccggcagctacgcccgccagctccagaccgatgacggcaacgattgcgcccattgccgcaggtggaaacagcacgtccagccagccggtccccgctttcttcacgataaaagaaaccaggcagaacagcacgccgcacataataaagccgcccagcgcgacttcataccccaacggcaacagtaacaataccggtgaaataaaggcaaagctggaaccaagataagccggaattttccctttacagatgaagagatacagcagtgttcctataccgttaaataacagtacagtcgccgggttaatatgaaataagacgggcaccaggacggttgcaccaaacatggcgaacaaatgttgcaaactaagcgggattgtctgtaaaagtggcggtctttcactcaccccgatagcacggcgcgtcatagtattatcctctgtattatgtgttataggcgctttactcaaaaaaaagccgactcttaaagtcggctttaattatttttattctttatttcgtaccaaagattttgtcaccggcatcgccgaggcccggaataatgtatccgtgctcgttcagtccctggtcaatcgatgcagtatacagttcgacgtccgggtgcgctttttccagcgcagcgataccttctggtgcagctaccagcaccaaaactttgatgctgctgcagcccgcttttttcagcaggtcgatggtcgcgataacggaaccaccggttgccagcattgggtcaacgatcagcgccatacgctcatcgatgttagaaaccagtttctggaagtacggtaccggctccagcgtttcttcattacggtacataccgacgacactgatgcgcgcactcggaacgttttccagcacaccgtccatcatcccaagacccgcacgcagaattggcacaacggtaattttcttacctttgatctggtcgatttctaccgggccgttccagccttcgatagtgactttttccgtttcgaggtcggcggtcgcttcgtaagtcagcaggctacccacttcggaagcgagttcgcgaaagcgcttggtgctgatatcttgctcacgcatcagtcccagcttgtgtttgacgagtgggtgtttgacttccacgatcttcatactctttctcctttgaggggcagccacaaaaaaaatcgacggattatacctcctttcttcaaggcggcaatattattttcgttgactttagtcaaaatgataacggtttgagataaagttattttatattcaaatggttatggaagaagattattccatccgaaaacgatcctttgccctggtacaagtattctttcgccgcgcgcctggggaaaagacgtgcaaaaaggttgtgtaaagcagtctcgcaaacgtttgctttccctgttagaattgcgccgaattttatttttctaccgcaagtaacgcgtggggacccaagcagtgaccgataaaacctctcttagctacaaagatgccggtgttgatattgacgcgggtaatgctctggttggaagaatcaaaggcgtagtgaagaaaacgcgtcgtccggaagtgatgggcggtctgggcggcttcggtgcgctgtgtgcattgccgcaaaaatatcgtgaacctgtgctggtttccggcactgacggcgtaggtaccaagctgcgtctggcgatggacttaaaacgtcacgacaccattggtattgatctggtcgccatgtgcgttaatgacctggtggtgcaaggtgcggaaccgctgtttttcctcgactattacgcaaccggaaaactggatgttaataccgcttcagcggtgatcagcggcatcgcggaaggttgtctgcaatcgggctgttcactggtgggtggcgaaacggcagaaatgccggggatgtatcacggtgaagattacgatgtcgctggtttctgcgttggcgtggtagaaaaatcagaaatcattgacggatctaaagtcagcgacggcgatgtgctgattgcactcggctccagcggcccgcactcgaatggctattcgctggtgcgcaaaattcttgaagtcagcggttgtgatccgcaaaccaccgaacttgatggtaagccattagccgatcatctgctggcaccgacccgcatttacgtgaagtcagtgctggagttgattgaaaaggtcgatgtgcatgccattgcgcacctgaccggcggcggcttctgggaaaacattccgcgcgtattgccagataatacccaggcagtgattgatgaatcttcctggcagtggccggaagtgttcaactggctgcaaacggcaggtaatgttgagcgccatgaaatgtatcgcaccttcaactgcggcgtcggtatgattattgccctgcctgctccggaagtggacaaagctctcgccctgctcaatgccaacggtgaaaacgcgtggaaaatcggtatcatcaaagcctctgattccgaacaacgcgtggttatcgaataatgaatattgtggtgcttatttccggcaacggaagtaatttgcaggcaattattgacgcctgcaaaaccaacaaaattaaaggcaccgtacgggcagttttcagcaataaggctgacgcgttcggccttgaacgcgcccgccaggcgggtattgcaacgcatacgctcatcaccagcgcgtttgacagtcgtgaagcctatgaccgggagttgattcatgaaatcgacatgtacgcacccgatgtggtcgtgctggctggttttatgcgcattctcagcccggcgtttgtctcccactatgccgggcgtttgctgaacattcacccttctctgctgccgaaatatcccggattacacacccatcgtcaggcgctggaaaatggcgatgaggagcacggtacatcggtgcatttcgtcaccgatgaactggacggtggcccggttattttacaggcgaaagtcccggtatttgctggtgatacggaagatgacatcaccgcccgcgtgcaaacccaggaacacgctatttatccactggtgattagctggtttgccgatggtcgtctgaaaatgcacgaaaacgccgcgtggctggatggtcaacgtctgccgccgcagggctacgctgccgacgagtaatgcccccgtagttaaagcgccagctctgccgctggcgtttttcaattcacctgtaaatcgcaagctccagcagtttttttcccccttttctggcatagttggacatctgccaatattgctcgccataatatccaggcagtgtcccgtgaataaaacggagtaaaagtggtaatgggtcaggaaaagctatacatcgaaaaagagctcagttggttatcgttcaatgaacgcgtgcttcaggaagcggcggacaaatctaacccgctgattgaaaggatgcgtttcctggggatctattccaataaccttgatgagttctataaagtccgcttcgctgaactgaagcgacgcatcattattagcgaagaacaaggttccaactctcattcccgccatttactgggcaaaattcagtcccgggtgctgaaagccgatcaggaattcgacggcctctacaacgagctactgctggagatggcgcgcaaccagatcttcctgattaatgaacgccagctctccgtcaatcaacaaaactggctgcgtcattattttaagcagtatctgcgtcagcacattacgccgattttaatcaatcctgacactgacttagtgcagttcctgaaagatgattacacctatctggcggtggaaattatccgtggtgataccatccgttacgcgctgctggagatcccatcagataaagtgccgcgctttgtgaatttaccgccagaagcgccgcgtcgacgcaagccgatgattcttctggataacattctgcgttactgccttgatgatattttcaaaggcttctttgattatgacgcactgaatgcctattcaatgaagatgacccgcgatgccgaatacgatttagtgcatgagatggaagccagtctgatggagttgatgtcttccagtctcaagcagcgtttaactgctgagccggtgcgttttgtttatcagcgcgatatgcccaatgctctggttgaagtgttacgcgaaaaactgactatttcccgctacgactccatcgtccccggcggtcgttatcataattttaaagactttattaatttccccaatgtcggcaaagccaatctggtgaacaaaccactgccgcgtttacgccatatttggtttgataaagcccagttccgcaatggttttgatgccattcgcgaacgcgatgtgttgctctattatccttatcacacctttgagcatgtactggaactgctgcgtcaggcttcgttcgacccgagcgtactggcgattaaaattaacatttaccgcgtggcgaaagattcacgcatcatcgactcgatgatccacgccgcacacaacggtaagaaagtcaccgtggtggttgagttacaggcgcgtttcgacgaagaagccaacattcactgggcgaagcgcctgaccgaagcaggcgtgcacgttatcttctctgcgccggggctgaaaattcacgccaaactgttcctgatttcacgtaaagaaaactgtgaagtggtgcgttacgcacacatcgggaccgggaactttaacgaaaaaaccgcgcgtctttatactgactattcgttgctgaccgccgatgcgcgcatcactaacgaagtacggcgggtgttcaactttattgaaaacccataccgtccggtgacatttgattatttaatggtgtcgccgcaaaactctcgccgtctgttgtatgaattggtggaccgcgagatcgccaacgcgcagcaagggctgcccagtggtatcaccctgaagctaaataaccttgtcgataaaggcctggttgatcgtctgtatgcggcctccagctccggcgtaccggttaatctgctggtgcgcggaatgtgttctctgatccccaatctggaaggcattagcgacaacattcgtgccatcagtattgttgaccgttaccttgaacatgaccgggtttatatttttgaaaatggcggcgataaaaaggtctacctttcttccgccgactggatgacgcgcaatattgattatcgtattgaagtggcaacgccgctgctcgatccgcgcctgaagcagcgggtgctggacatcatcgacatattgttcagcgatacggtcaaagcacgttatatcgataaagaactcagtaatcgctacgttccccgcggcaatcgccgcaaagtacgggcgcagttggcgatttacgactacatcaaatcactcgaacaatctgaataaccctatgccaatacacgataaatcccctcgtccgcaggagtttgctgcggtcgatcttggttcaaacagttttcacatggtcatagcccgtgtggtagatggtgccatgcagattattggccgcctgaaacagcgggtgcatctggcggacggcctggggccagataatatgttgagtgaagaggcaatgacgcgcggtttgaactgtctgtcgctatttgccgaaaggctacaggggttttctcctgccagcgtctgtatagttggtacccatacgctgcgtcaggcgctgaacgccactgactttctgaaacgcgcggaaaaagtcattccctacccgatcgaaattatttccggtaatgaagaagcccgtctgatttttatgggcgtggaacatacccaaccggaaaaaggtcgcaaactggttattgatattggcggcggttctacagaactggtaattggtgaaaatttcgaaccgattctcgttgaaagccgccggatgggttgtgtcagctttgcccagctttattttcatggcggggtcatcaataaagagaattttcagcgcgctcgcatggcggcagcacaaaaactggaaacgttaacctggcaatttcgaattcagggctggaacgtggcaatgggcgcttccggtaccataaaagccgcccatgaagtgttaatggaaatgggcgagaaagacgggataattaccccggaacgtctggaaaaactggtaaaagaagttttacggcaccgtaatttcgcatcgctgagtttacctggtctttccgaagagcggaaaacagtcttcgttcctggactggcgattttatgcggtgtgtttgatgctttagccatccgtgaactgcgcctttctgacggggcgttacgcgaaggcgtactgtatgaaatggaaggacgtttccgtcatcaggatgtgcgtagtcgcactgccagcagcctcgccaaccagtatcacatcgacagcgaacaggcccgacgggtgctggataccactatgcaaatgtacgaacagtggcgggaacagcaaccgaagctggcgcatccacaactggaggcgctactgcgatgggccgccatgctgcatgaggtcgggttgaatatcaaccacagcggtttgcatcgccactccgcttatattctgcaaaacagcgacttgccgggttttaatcaggaacagcagctgatgatggcgacactggtgcgctatcaccgtaaagcgattaaactcgacgatctgccgcgctttaccttgtttaagaagaaacagttcctgccactgattcagctattgcgccttggcgtattactcaataatcaacgtcaggcaaccaccacaccgccaacattgacgctgattactgatgacagtcactggacactgcgtttcccgcatgactggtttagtcagaatgcgctggtactgcttgatctggaaaaggagcaagaatactgggaaggcgtggctggctggcggttgaaaattgaagaagaaagtacaccagaaatcgccgcttaatgctttgcgggccgacgagaaatgtcggcccgcattattcaggcactttcgcgaatgggttcgatttcattcagcgtatcaattaacggttgcggcttaccaataagataaccctgcatataatcgatccccaaagagagcaccgcctcgcggatctcttcgttttcaacgtactctgccactacccgcattttcttcattcgcgccaggtggcaaatcgacgccactatctgataatccagactatttgacacaatattgcggataaaactgccgtcaattttaagcagatcggcattcacatttttaagccgcgcatagctggcgtagccggtgccgaaatcatcaatcgcaatctggcagcctaattcctgaagatgctgcaaggtgatttgcgcctgcttaacattggtcagagcattactttcggtgacttcaaaaataagttgccacgcttcaatctgatatttagccagcagctgactgacttcaacaggaaaacgagcctgacataccgaggttggagacagattaatagcaaaacggtgagcgggcatcttcgctctgttttcagccataaattgcagcgtatgctcaatgacccacatgtcgatactcgacgataaaccaaattcgtgcgcgaccggtaagaagctatcggggctgatcagttcatcattctcacctttcatgcgcagaagaatttcatggtagacatcaccacgcataccggtaatcggctgggccatcaggaaaaaatggttgtgttccagcgcccgctgtagccgattcatcatcgcgactttatctttcaattcgcgttgcaaatacattgctccgcgacgctgcatattttccggggcgttggtcacgatggaaagttcggccactgtatttagctctcccagcagcaggtagatatgattcactggcgagcgcacatagcagtaactgacgccaatctgcggttgcatcggcattccatcccaaaagaaacgaaattgcttgagatggctatccagtgcggtaatgcgctcctggtgcgattctgtattcagccgcagcgcgagatcgttacccgaaagctgataaacatcttcacccggttccaacaatggtgacagccagtgagaaagtttttgcttgtattgaatccgcagcatgatgccataattcttaaccagcatttccatgccagggatgcgtaaataacaaagcgcagaccagggggcatcacgtaacgcgcgattcagggcgcgaacatttggcagatgaaccaccgggtccacatacgcaagccgctgaatgcgtctgactaccgctcgctgacgggttgccagtacagccatataattgacaataaaagagaataccagataactggaggaggttatggtgagctgcgtggtatagccaggataaatgggaatgtaattttgatagctgtggatgctgatcatcaacacgaccgcccagagcaatgaaatcagcttataaccatagcgcatcgctccccacatcatcaggggcagcaataatgacaaggtgtaattggtgctaaaaatcgtgcttttttcatttaacggcatgcataacagcaatagtaaagcacctaatgccagtagccagattgcgaactcttttttggtaactttggcatcaacctgctgttttaattgcgaataatagctacgtaaataaaacggatttcgcaccacccgaatgatgaagtagcacagcgggacaccaatcagattacccaccagcaaggcctgataattgattaaggtcccgaggttaaagggcatgacgccgaccagattttctctgctcgccagtaaccctacaaacgcagcaaactggaaaagtatcagaaacagcgttgcaggaaacacaatctgccagaatagtcgctgggaaattaaacggctatcaccatgtgaaacgttgttacgccggggggtaaaaaccctgtaaccgccccaacagagaatgataatgataataaaattagccgttaatgagagcgtttcgtaaaaacccagctctgcatatttgcggacaaaaatccctaaggcgatccctggcaatgccgcccagctgaaaaacatcatcatgctgatcatcagtgccagtggcagataaaagagaaaaacttcaccggaagaaatatgcgcgaaagtattaatgtgggcgaaaatgggcaagattaaagaaggcaggaacagcggaagcccccaccatttatcacgtatttttatataagttgcattcagtttcatagatgctcagcagaatcccccacatcctgaaggaggtgtattcagacaggcatcccacctgacttcgaatgatgattattcatcactatagagagcaatgattctaagtgtcatatgaaagttccaattgatatatatcaaacaaaataaccctgattaatgaattattacgtttatcatgttaactcatcattattacatcatcattgtaaataattaaattaactttcataacattaaaatatgtatcaactgacgcttttttacataacgaagaattgaccattttgtcctgttgtgccttaatgtaagtaccgtccacggcgtgggacatacttcaaggaaccttttgtgagtcaggcaaccagtatgcgaaaacgacaccgatttaacagtcgcatgacccgtatcgtactgctcatcagctttatcttcttctttggccgttttatctactcgtccgtcggtgcctggcagcaccatcagagcaaaaaagaagctcagcaatccacactctccgtcgaatcaccggtacaacgttagcggttaccttctccactctcacagaacataacggcacctcgctgtcggatgcttttgctctttgagattatcaaagcggcagatattctttcatcttaaattttacgtctttgttctgactgaagttcatcctgttcggctgcgaaataaatacatcattaatacatatgttgtgatgatgtatttttataaattatttcccgcatgaattttaataaatttaatctattcctttatacgcaatacatttactttcctcttttgatgatcttaaatgtctcatttttcgtaatgtgtataacaaggaatagtgatgaaatttaaaaaatgtcttctgcctgtggcaatgttagcgtcattcactctagcaggatgccagtcaaatgctgatgatcatgccgccgatgtttatcaaaccgatcaactgaataccaaacaagaaactaaaaccgttaatattatttccattcttcccgcaaaagttgccgtagacaacgcccaaaataaacggaacgcacaagccttcggcgcgcttattggcgctgtcgctggcggtgttatcggccacaacgtcgggtctggcagcaattccggaacgacggcaggtgcagttggcggcggagctgtaggcgcggcagcgggttcgatggtgaatgataaaaccttagtggaaggtgtttctttaacatataaggaaggcaccaaagtgtatacctccacccaggtgggtaaagagtgccagtttacgacaggtttagccgttgttattaccacgacgtataacgaaacgcgtattcagccaaataccaaatgtcctgaaaagagctaataatcaggaggagtcatgaagaaagtttttctttgcgccatcttagcctccttaagctatccggctatcgcctcatcattgcaggatcaactctcggctgtcgcagaagcggaacagcaaggtaaaaatgaagagcaaaggcagcatgacgaatgggtcgcggagcgcaacagggaaatccagcaagagaagcaacgtcgcgcaaacgcccaggccgcggctaataaaagagcggcaacggcagcagcgaataagaaagctcgtcaggataaactggacgccgaagccactgcggacaaaaaacgcgatcaaagttatgaagatgagctacgtagcttagagattcagaaacaaaaactggcgctggcgaaagaagaagcccgcgtcaagcgcgaaaacgaatttatcgatcaggaactgaagcacaaagctgcgcaaaccgatgtggtgcaatctgaagctgacgcaaacagaaatatgactgaaggcggtcgcgatctgatgaaaagcgtgggcaaagcagaagagaacaaatcggacagctggtttaattaatcgatgtaagtaacttcaagcctataattcttgaagataaaaaaccctctgtagtaacagagggttttgttcattcatagtgcagggatcaaaatcattcccactcaatggtagctggcggcttgccgctgatgtcatacaccacgcgggaaataccgttcacttcattgataatacggttggaaacgcggccgaggaagtcgtacggcagatgtgcccagtgtgcggtcataaagtcgatggtttcgacagcacgcagagagacaacccagtcatacttacgaccatcgcccattacgccaacggaacgtactggcaggaagacggtgaacgcctggctgactttgtcgtacaggtccgctttacgcagttcttcaatgaagatggcgtcagcacggcgcagcaggtcacaatactctttcttcacttctcccagaacacgaacgccaaggcctggtcccgggaacgggtgacggtacaacatgtcatacggtaggcccagctccagaccaatcttacgcacttcgtctttgaacagctctttcagcggttcaaccaggcccatcttcatctctttcggcaggccacccacgttgtggtgagatttgatgacgtgtgctttaccggttgcagaagcagcagattcgataacgtcagggtagatggtgccctgcgccagccacttcacgtcttccagtttcagcgcttcttcatcgaatacttcaacgaaaacgcgaccgataattttacgttttgcttccggatcgttttcgccagccagcgctgacaagaagcgatcttctgccggtacgtgaacaatgttcagaccaaagtgatcgccaaacatatccagaacctgctctgcttcgttgagacgcagcaggccgttgtcgacgaatacgcaagtcaggtttttaccgatagcgcggtgcaacagcattgcggtaacggaggaatccacgccaccagagaggccgaggatgactttatcgtcgcccacttgctcgcggatgcgggctacagcgtcgtcgataattttcgctggcgtccacagggcttcacactggcagatatcacgcacaaaacgctccagcatgcgcataccctggcgggtgtgagtcacttccgggtggaactgtacgccatagaagcgtttttcttcgttggccatgatggcaaacgggcagctttcggtgctggctacggtgacgaagtcggacgggatagcggtaactttatcgccgtggctcatccagacgtccagcagcggtttaccatctgcggtcagcgcatcttcgataccgcgaaccagtgcgctgtcgtttacgacttcaacctgcgcgtagccaaattcacgttcgttagaggcttcaacgtgaccgcccaactgcattgccatggtctgcatgccatagcaaacgccgaataccggtacgcctgcttcaaagacatactgcggcgcacgcgggctgttttcttcggtggtgctttccgggccgccggaaagaataatgccgcttggattgaagtcacgaatttgtgcttctgtcacatcccacgcccacagttcgcagtaaacacccagctcacgcacgcggcgcgcaaccagttgagtgtactgagaaccgaagtccagaatgaggatgcgatgcttatgaatgttttccgtcattgacgcttattccgaggcaagtgaaacagataatataaatcgcccgacatgaagtcgggcgaagagaatcaggagcccagacggtagttcggggactctttagtaatggtcacgtcgtgaacgtggctttcctgaatgcccgcaccgctgatacgtacaaactccgctttagtacgcagttcgtcgatagtaccacagccggtcaggcccatacaggagcgcaggccgcccatctgctggtgaatgatctctttcaggcgacctttataggctacgcggccttcgataccttccggcaccagtttgtcggcagcgttgtcgctctggaagtaacggtcagaagaacctttggacatcgcgcccagggaacccataccacggtaagatttgtaagaacggccctggtagagttcgatttcacccggagattcttcagtacctgccagcatggaacctaccatcaccgcgcttgcgccagcggcgatagctttagcgatatcgcctgagaaacggataccgccgtcagcgataaccggaataccggtgccttccagggcttctactgcatcagcaacggcggtgatctgcggaacacctacgccagtcacgatacgagtcgtacagatagagccagggccgataccgactttaaccgcgctgcaaccagcttctgccagagcgcgtgcccccgcagctgttgccacgttgccgccgatgatttgcagatccggatatttagcacgagtttcacggatacgctgcagaacgccttcagagtgaccgtgagaggagtcgatcagcagaacgtcaacgcctgcggcaaccagcgcatcgacacgctcttcgttaccagcgccagcaccaaccgctgcaccaacacgcagacgaccttgttcgtctttacaggcgttcggtttacgttctgctttctggaaatctttcacggtgatcatgccgatcaggtggaattcgtcatcaaccaccagcgccttttcaacgcgtttttcgtgcatttttgccagcaccacttcacgggcttcgccttcacgcacagttaccagacgctctttcggcgtcatgtaaacgctaaccggttgattcagatcggtcacaaaacgcacgtcacgaccggtgatgatgccgaccagttcgttttcttcggtaacgaccgggtaacccgcaaagccgttacgctcggtcagttctttcacttcacgcagcgtcgtggttggcagtacggtctgcggatcggttaccacgccagattcgtgttttttcacacggcgaacttcttctgcctggcgttcaatggacatgtttttgtggataaagccgataccgccttcctgagccagagcaatagccaggcgcgcttccgttacggtatccattgctgcggaaagcatagggatattcagacgaatagttttcgtcagctgggtgctgaggtcagcagtattcggcagaacggtagaatgagcaggaacgaggagaacgtcgtcaaacgtcagagcttctttagcgatacgtagcatgggcaatatctcgaccagagtggttaataaatattgccgcggcattatacagagcgtaaccgattgcatctacccctttttgcaaaaaatgcttgctatccccggagggcgggttactatcgactgaataacctgctgatttagaatttgatctcgctcacatgttaccttctcaatcccctgcaatttttaccgttagccgcctgaatcaaacggttcgtctgctgcttgagcatgagatggggcaggtgtggatcagcggcgaaatctctaattttacacaaccagcctccggtcactggtactttacgcttaaagacgataccgcgcaggtgcgctgtgcgatgttccgaaacagcaaccgccgggtcaccttccgcccacagcacgggcaacaggttttagttcgcgccaatattacgctctacgagccgcgcggtgactaccagattatcgtcgaaagtatgcagcctgccggtgaagggttgctgcaacagaagtacgaacagcttaaagcgaagttgcagactgaaggtttgttcgatctgcaatacaaaaaatcactcccctcccctgcgcattgcgttggtgtgatcacctcaaaaaccggtgctgcgctacatgatattttgcatgtgttaaaacgtcgcgatccttctctgccggtgatcatctactccaccgccgtacagggggatgatgcgccggggcaaatcgttcgtgccattgaactggcgaataagcgcaacgagtgtgacgtgttgatcgttggccgtggcggtggttcgctggaagatttatggagttttaatgatgagcgtgtggcgcgggcgatttttgccagtcgcattccgatagtcagcgccgtcgggcatgaaaccgatgtgacaattgctgactttgttgctgatctacgtgcgccaacgccgtcagccgccgctgaagtggtgagccgtaatcagcaagaattgctacgtcaggtgcaatcgacccgtcaacggctggagatggcgatggactattatctcgccaatcgcacgcggcgctttacgcagatccatcaccgattacagcaacagcatccgcagctccggctggcacgtcagcaaactatgctcgaacgtctgcaaaagcggatgagctttgcgctggagaatcagcttaaacgcgcgggtcagcaacagcagcgattaacacggcaactcgtccagcaaaatccgcagtcgcgtattcatcgcgcgcaaacgcgcattcagcaactggaatatcgtttagcagaaaccctgcgcgcacagcttagcgccacgcgtgaacgtttcggtaatgcagtaacacacctcgaagccgtaagcccactgtcaacgctggcgcgcggttatagcgtcaccagcgccgctgatggcgcggtgttaaaacaggttaagcaagtgaaagtgggtgagacactgatcacacgactgggagatggtgtggtgattagtgaagtcagcgccgtaacaaaaacccgcaaatcacgtaaaaaaacgtctaatccgtagaccggataagaggcgccagcatcgcatccggcaataactcccaggctactccagatccgccatgctggttactggaagcaggtcaccagacccggtttatttattagcgtgatactacaatcctgtgctccggtaccttcgtccatcccacactgttgagaggacaaataaggaaaactgggtgaagacggccatcccagtgaattaaaaacagtatgcaacaactctaattcattgtatgtcggtgtattttctatgctgccacactgccttgcgatatcccatttactggcatcaatgatatgtgcagaagcccagttttcgggtaatgactccaacttactgatagtgttttatgttcagataatgcccgatgaccttgtcatgcagctccaccgattttgagaacgacagtgacttccgtcccagccttgccagatgttgtctcagattcagattatgtcgctcaatgcgctgagtgtaacgcttgctgataacgtgcaactttcccttcaggcgtgattcatacagcggccagccatccgtcatccataccacgacctcaaaggccgacagcaggctcagaagacgctccagtgtggccagagtgcgttcaccgaagacgtgcgccacaacagtcctccgtatcctgtcatacgcgtaaaacagccagcgctgacgtgatttagcaccgacgtagccccactgttcgtccatttcagcgcagacaatcacatcactgcccggttgtatgcgcgaggttaccgactgcggcctgagttttttaagtgacgtaaaaccgtgttgaggccaacgcccataatgcgtgcactggcgcgacatccgacgccattcatggccatatcaatgattttctggtgcgtaccgggctgagaggcggtgtaagtgaactgtagttgccatgttttacggcaatgagagcagagatagcgctgatgtccggcagtgcttttgccgttacgcaccacgccttcagtagcggagcaggaaggacatctgatggaaatggaagccacgcaagcaccttaaaatcaccatcatacactaaatcagtaagttggcagcattacccagttttcgtagttaataatcggtgaggatacgggattagccccggacggcaattccgtcgttaacaacggtcgatgtagcgatttactattcaccactaccgtgtctgccatatgtccccaaaaatgcgccgatgaaacatttgggctggttggcaccgtaaaaatagcgtccagcgtgtctgtcgcggaagcgtaattagccagagtaaccgtcagtggcattttataaccaggggtattatcctggcggagcgaaaaacttgccgtcccatccgcgcctgtcatgccactaatggtattaccgctttcactcagcgtaacagccgaacctgataacggctgaacgacgagatcgtccatcgccactacattgccatacaacgttgccccagcgttacgcggcgatgcctcaccacgtttcaaagtaaattcaacattcggcaccgtattcccggcgctgtctttcaccgtcacggtaacggacatggcttcgccttttttcactttcgccgcctgagtggctgcatcaaacgctgttgaggtaagtgtgacgctggaaacggttgaacgcgcgttagccaggcaaggctgaaatgattttgttgaacccgtatacagcgtgccatttctcaaatcaaccgactggtctttaccatcggcggatttatcctctgcccaccaagtgtaatacgcaggccagccagtttcagtgacaaacgtgttattcggataacgcgcagacaacgaacttaaatcattgaatagtggctgccttgctacttcacaagggctcacactcgcatctgatttctgtgttggggtaaagtacggccagtcttcattattgttattgatcttgccgacgccagaagtcgatgtcagttcactccacaatttcgggcgttcaaataccgcaccattcactgccgtcaaggttgctggcatatgcccccagtagttagccttcgcagaatccgggctggtcactaccgtgaatatcaggtcctgattagccgtaacctgcggatttcgcgccaatgaagctgtaaacggcgttaccagaccaacggtgttattttgggtaacgttgaacgttatcgtgccatcactgccggtgaagccgctccatgccgacgtattctggttgaaggagatacgcgccgatgtcggggtgacttcatctaaaatgagatcatctacggtattggaggatacagagatccctgaacggcttttcgcctgcacgcgcttgagcgtaacaccttcgccgccaacaggattaccattggcatctttgatcgtcaccacgatgggaagcatctcaccttttttcacagatgacgtgggggtaccaccattgctggcagttcggccctcatcataggcagtcgatgacagcgtaaggcttgctggtgccgaatgtggctgcgtcagacagagcattaaagcgtatccattaatagtcgtcgtcgattgtcccgttttcaaattaatgacgccgtaataccacgtcaacgcgtcagtggtgctcatttcataagtccaccaatttccacttccggcagttataggcaaccccaaatctgtcagtattgtcccgcctggatgatcattatatagcccctgtaactcattgagacgcggctgatactcaaccgggcaatccggcgtaactttattggtataaaaaagtatgaccacgactcattattattacttaccgaggaccccaaggtcgcttctgctgccagtagcggtcgtttaaaggtcacccccgccctactggtaaacgtgtcgggcatatgaccccagtattttgctttcggtgagttcggactggttatcacagtgaaaataacatccatcgtggcactttttgtggtgtcgcgcatcaatgttgcagtgagcggagttgccagcccataagtctcgttttgcgtcacatcaaaagtcgctttaccatcacttcctgtcgtcagaagtgcctgtgccccattattatagagtgacatgtttactccggcaggggtgaccggcacgatagtaagatcatcatacgtagaatctagcctgttttttgcacgatccaacgcagtcccgcgtatgagattaaagtttgcgcctggcaacagatttcctccgctatcccgcacaatcaccgtcatccggatcgccgtacctttcgccgccgttgcactagggcgaccatcgttgctggccgttttctccgcatccagtgccgtggaggtcatctctatagaagctgccactgcatgagggtttaccagacaggacacaaatgccacggtgtttgataatgccctggagcttgatccattcgataaattaatagactgatcgtaccagacgttcgcgtaggcaattttatcgtaagcccaccaggtgttagtcagcggaaggcctaaatcggtccctatcgcaccattaggatgttcactgtataactcttgaaattcgcttaataacggttgataaggttcgccgcagtctgatttgctgacatcattttttgctgccgtattcaaagaaagccatgattcattattagccatggttgactgccccgctggatgctcggcagtaagcaatggccgcttaaaggcaattcccgaccgggtagtaaacgtttcaggcatatgcccccagtaacttgccagtggcgtatccgggctggttatgacggtaaacatgaccggtaatttgttggattctatcgtcagctgatacaactgggcgtacatattggttaccaggcccatagaatcatcttgttttaccgtaaaggaggtagtcccgtccgcgccagtcaccccataaagcaggcttgaagaactattcatcctcgcagaagcgcctgccgcgttaattaccgtaatcgacttatttatcatctcggcattttgacggttcttcgagccttcacgtctgagaataaaggggacattgggcacgccatttccctgcgcatttttagtcaccacgcgaatcaccgcgtcttcgccttttttcactttcaacgcactcaaggtgtcgtcaactttgacaaattgcgccgtatcattcgcctcaacaatgatctgactggcaacggcgacaggcgtggtccggcagctcagtaatgcaccaccagatgagggcatctgcgtttcatctcctgtcttcagcgaaacgacatcatacgtaaaggtttgagtgaacgtatctgcaacggtattcgagatatagaacctcgacactggccagccaatagcatcatgtaatgcgctactcccctggtgcgcataaatggccctaagttcattgtcagttggaacatactccgcgccacaaccatttatcgaggtatcgttagccaggcccgacgggaacgtagaccaggcctccccctcttccaccagggtaccgatactggtggtagcactattctcgtccctcagtaaaggccttcgataaataagaccgtcatcgcctgtcgccgtttcagccatatgcccccagaatttggcttttggcgaatccgggctggtaagcaccgtaaagacaacgggaagcgtcgatttagtgctgctggaggaatccaacgctgccgtgagttctgtttttagcccggtagtctggtcttgcttcaatgtgaaagtggtgatgccatcagcacccgtcacgccataaataaccagggtcgttgaaagaaaatcatcttgagtatttccccaggcatccgttaccgccagcgaagcaatcgacgtcgtagttgacacattggccctgttcacgctggtgtttcgtttgagggtaaatgcggtatttcccacagggttaccctgcgcatctttagtggtcactcgtaatacggcttcttcaccttttttcgctttgacaacattattcatacggtcaaattttgtggggtctgcagcttcaagaacaatttggcttgccttaacaatcggcgtcgtctggcaggtaagcagttcttttgtggcagatggaattatcgaactggtgcctgaactgagattgacggccttgaagtcacgctgttccaggctactactacctgtcgtgctggaaaggtaacttgaggcgacgggccagccctgaaccgttttcatcgcatttccgcggttggcttcatacaatgactccagcccggcctgagagggaacatattcactaccacaaccattagaggatgtgcttatagcctgagcttgggtaaattgcgcccagtcttcattatcttccgcaatcgctgttcgacccgacgtactggataactctttcaacaataatgggcgtttaaagaccgctccatctgcagccgtcactgtttcaggcatatgcccccacattttcgccttatcgctgtccggactggttacaacggtaaaaatggtatcgagggtcgcttttttcgttgtatctgaatagagcgtagcggtcagcgacgttttcgtgccatgggtatccgggcgggtaatagtgagaattttagttccgtcgctgccggttatggcgctgtatgctgcagcggtattattaagcgaagtttcgtccgccaggccaccattgaccacaaccggcgcaaccagcgcatcaccgctaccagcaacgtgtttttcctctgagcgggtataaccatcgccacgtttcagggtaaagggtatatcacccaatggattgccctgcgcatcttttaccgtcacctttacctgtagcgtttcgccttttttcagcttcgctgcatttgcagccgcgttccactgcgccggatccaccacttccagcgtaatgctactggcaggattgttagccgtcgtcaggcaactgacataaaccgccgtgctaccgccaacggtccgcgccccatcgttgagggctatggtgtaataatgcggtacctgatctgcgggcgaactgctccagtagggctgacgctgcgttggccagccgtgtactgtctgtacaccgtcaccgttattggcatcatagagcgcgctaagctgagaacggcgtgggagcatattggcgccacagccacctttactggtgctggaggcgttggcctggctgactcgcgaccagacttcgttattttccgttaatgtgccgtccggactgaacacttccgcagccagtcggggtcgggcaaaggttaaagcatcgacggtaatcgtctcatccatatgcccccacatctgcgcgccaaccgcatccggactggtgagcgtagtgaaaatcacattgtaattaacagtattgggaatataggagttcacaggcacaatatttagcggcgtcgataagcccacaccttgcgattgcttaatttccacagtcgcaaaaccctgcgcatccgtagtaccggcatagactaaagacggttgcgatgttccgtagagtgtgccattcatctcgattgcgccgcgggttggatcatcaaaacctgtagtctgcccctgacgatttttccccatatctttagtgatggtgaacgcggtatacggcacgggtgcattattcaaggcattaaaggtgcgtaccgtcatggtgatcgtgtcacccactttggcctgcgctctgctgcctgcggaaacatcacgatcggtggtcgcggcaatcttggcgaccatctcattgcccgaacaagagagatagttttgcttaaagccggaataggtgtcgatgttgcccgtggccaggtttaccgacgcgtgcgacgtctcttccaccgcactaagatacgctttttgcaacgttggccagccatattcggtgccgatggcattggctggatgagcggcaaacaaactgtgcaatgaactttggctcggaatatgacctaaaccacactcagcctgcatactgctattctgatcaaacagcgcccagtcttcgttattttcccgcaccgatcccagttcgttgtcggtttcatccgccagccgtgggcgtttaaagatattgttcgcttcaataatgcccaacatatggccccacatccgcgctttgtcggtatcggggctggtgatcaccgtaaaaataacgtctttctcatccgaggcagtaaaatcactgcgcattctcgcggtgatgtgagttttcacccccacgccgcctggctgggtcagcgtcagagtggcctctccgttagcatcagtgatcccttcataggtatgggcgtcaactttgcgaacgttactgccgccatcaatttgtaccggatgcgtctcccacgcggcgtcagtttgattcttacggttaatgccgtcatccagatgcagcgaaaagtagtagtaagccagcggctgatcgttgttcttgctatcggtaatcgtcagacgtaaagaagcctcttcccccacctttactttcatcgcttttatcgtcgaatcatagctgcccggcgtcagtaccagcttcggttcaacatcgggcgcttctttatcgacacagctcacaataaacgtcgtatcgtccggtttttgcgcttcgctgcggttcgaaacatccgccgcatggtgctggccgctcatccccgccagtgatgaccagtagaaattaccctgcatcggccaaccagccacatcctgcactgacgttggcaccaccgtcgccagcgcaccgaactgacgcattccgggcaaaatgtcgcaatggttatccgcgccgctccaggtaaaggtggaccaggtttcattgtgatcgttaaccgtaccgtcttcattatcgacttccgccgccagttttggtcgactaaaagtgtaatcacgggccttcagcgtatcgggcatatgaccccacattgtagcctgcgggacatccgggctggtgaggacggtaaagatcactgccgtttcactggcctgagcaatacccgcgaggctcgcgaccaacggcgtttttacaccagggccgttggcctgggtgaccgtaaccgtggcaacaccattcgcatcggtagtaccacgatattccgtcgcggtggtggttaattcggtcgtgcccagttttacaggcgcagtattgttcaccacaccctggcggttttcagcatctttgcgtttgataacaaaaggaatattccccacaacattaccgacgcaatctttggtggtgaccgttaacgtgatactgccgccaaccgtcattttcgccgcacctgaggattcgtcatagcccgcagcgctgacggaaataaggtcaccctgcgcgggcgcaatcttcagcgtcactttctgatcggcgagcgtcagaacactttcatagggatagcccgtcgaggtgagtaaatataacagcggcatggtctgctggggatcaggctgcgcccaggcaaccagcaaacgcccggcaaggccctgagcgcaaaacgagcgatctgcgactggctgtgggtccagtaaggtgcccggcgtcgcggcatccgcccaaactaaagatattgccggtggcgtttggttttcccaacgtggggtggcaatgatatcgccttctctgtcttgcggattggtgacgagcaatttagagacgctaacatccgcgctgaattcactcggtttagcggtaaacgctacatcatgcgtctttgcaggatcgagaaagacactgccctggtagacgggtatgctggcgctgtcggcagtaggcacggtaccgttaaattcgccgaccgtatctgaagagtcttgccatgcagattctgcccatgaccacccaggcagcattgcgcttatcagcaatgcgcataacacaaggattttattcagggtcagggacatgacagaaactccaccggttgttaaacggacgcttgtcgagtacgcgttatttgtgtttgtaaataatgtgaagtttgtaaccctgtaccccgtcgccgttggtcgggatggaaagtgcctcttttccatcgcgcgcagggccgttaaggttggttctggcttcgtcgttggtcgcagggatgaccaaattgttattatcgaagcttgagttaacgatgccacccgaagtgccaagctgttggctgctgccagaaagtacccaacggaagtcataattggcggtgacgtcagcatcggtacccgcatcaaacttgccatttttgttctcatccgagtacagtttggccacgtaggttttgccaagttcgattggcgtgctaccgttgataaggttgatactggtaccatcaacaaagatggcgactttcaggttctggttaaccaccggccccggtgcaacgttatcgctgtcgcttccgccgccgctggcagtagaaacgtcataaagatgcagcgcagtcccgacgtttggcgtaccggtctgcgtggttggcgtaatttcaataccgatatagcgaccacggtcggcatcggtaagagtgtaactggtcaccttcgttgccagctcttttggatcccccccctgcgcatccttgtagctcatccagcggatagtatcgatagttttcgcgttatcgcccaatcctccaagatccacgtcgccttcggtatcaccaatttcccaacttacggttaatttatcacccgagtaaagacgcttgtccgtttcactgccttgcgggcgagcgccttttagatcagaagtcaacgttacacggtcggcatctgtcgtagcacttcccccttccgaatagagccacggaatggtcccctggaaaatattggtttcgccgctgtcgacccaggcactgtcttcagccagcgccacaggtgccacacaataacctgccagtgccagcgctaatgcgatccgggtcagaccgcgtcttttatcctgcttcattgatgctctccttaatgaaccttcagcgactggccgactggccttacgccaatcttattttttggtatacagcacgcgtaaaccgtacccctgcaagccatctcccgcttgtgcgccataggtttgcgccgcttcacggttagtggccggaatcacaatgtcctcattggaagtgttcgcctgtgcatccacttcaccattgatgctcttgccggtaaattcccacttgtagtcgtactgcgccatctcttcgtcagtcagtttttcgacctgctggaagacaccgtctttattgttgtcgcgccataaaacaaatcgataaatgttgttaagcggcaacggttctttatctttacctatcaggttgctgggtttagccgcccccactcgatagataaaagcatttagcccaccaatttctgccccgaggaaagtgacatccacatagttactgtcatcgtagggcgcggcttttgctttccagcgataggtgccgggtaaggtactggagagggtgacagtgcccttttctttatcttgtttagcgataaaaacgcaggggttgtcggtcgagcaaggcttgttggttaacgtcactcgtttgtcctgcgcgtcgtaaagctgcggcgtgaggttatcttccggcagcgcatcgccattgcggtcggttacatcgagatccatcactacaccatctacaccatcggcctgtgcgctggcttcgtggctgtgattgctcttatccgggacattggcgatgttgttaacgatgagctcaattttacggtcctgttgaacggtgatttccaccacaccggagctctgccgattgcctttttcatcttccagcgccaggcgtacccgccaggtgttgagtttttcttgttcggcttgatcggaactgtactgccaggcaggcagcaccaggttccagtggttattgttaccctctgtcagagtattctctttgataaccggcatcaccagcgtgcgggcagcattgtttttcacctgccaggaggcagcaacgattttgtaatgatgattaatgagtgcgttaatggtccacttacatttttccagaccgacggcttcttcgggcgtatctttaatcacgcactcgggatgttcattcgtgacgtcggctttcagccacaaagtgacatagaggggatctttctctttgtattccagaacaataaagttgttacgttcaacaaagtcatgacggctacccatgagcgagtgagccgcgctcactttgtcaggatcaagctggtctttgagcgggacgccaaactggtagttcagcgttgcgttaacagaaagatcggtattatcgccagtgccagctttgaaatctgtaccgacaacaatgagcggaacgggctggtatttcacacccagcgtgacagcgaagggatctttctccagactatcggtaccaaaaagcgcgacttcattcccataatattgttcgaagacaatttttccgccaagctgcgggtaagcgggtagccaggcttcagcgcgaatatcccagccgcgcgcagggcgttcttcataaaagtcgaaatcttcagagtctttccagtcagaaagtgggtgataatagttgcctgagaattttaaataatccgtccaggcttcggcgcctaaacctaaacggcgatgtccacgggtaaagtcataatcataaaatatatttccacccaatagatatttatcaaaattataccttaccccaaggccaatattcccgatcgtacgatcttcttttcgttgcgcagaaaattggctgaaataaacagtggtttgattatcgtaccagggaacaaaataatcgatggaactgccatccagatcgccgccctgaccaatggagaggttcgaacggaccttaccgtagggagagagtgtgtcttcaatataagattgtgcggttgaggtgatttgactttgcagatagcttctggcctgagattccagcgcctcaggggtcaagttttcaaacccttgcgtggcggagttgatgacgtaatcggctccgcgctctttcagcgatttacccttgttggtttgttcatcctgttgtgctgcctagctacctaaatcaggtaacgattcgttttgcttaacatttatctctggcgccgcgaaagcagcaccagagataaatgttagaataatacagcgtttccatcgcagcatgcactttccctgtgacaatgatacagtcaaaaataagctttaatattgtatccctgattattcagaaaggcatgtcataaagagtaaatatattcttaattatttaaattagtgatttcactcaaatacattagttattccactaataacagattgtttatcattcatatattaaatataaatgataaaacaatacattcacatgatattaagcaataataaattcaacgcattttttagatattaaaccgtgcccatgttggcagaaataatccacagcaccacaagcttttaacacttgtaacgcctgatgacactcagggcaaagtgcctggacggtaaagtctttgtcgcaagttgcacagtgagcagtctcgccattgcgttcgagaggggttttgcaggttggacagttgagtgccataaatactcctcgcgtgttattcggcttccctctccgtgtggaaagggaaaccagataagtgattacttacttttcttgatatgcttcatcagacgcttacgtttacgcatctgggttggcgtcagggtgttacgcttgttcgcatacgggttttccccttctttgaactgaatacgaatcggcgatcccattacgtccagcgatttgcggaagtagttcatcaggtaacgcttgtaggaatcaggcaggtctttcacctgattgccgtgaatcaccacaatcggcgggttataacccccggcgtgggcgtatttcagcttcacacgacgaccgcgtaccagcggtggttggtgatcttcaacagccatcgtcatgatgcgcgtcagcatagaggtccccacacgacgggtggagctgtcatacgcttcacgtactgattcaaacaagttaccaacaccactgccgtgcaaggcagagataaagtgcacacgagcaaaatcgataaagcccagacggaagtccagcgtctctttcacctgctctttcacttcctggctcaggccgtcccacttgttcactacaatcacaagtgagcgcccactattgagaataaagcccagcaaggagagatcctgatcggaaataccttcacgcgcatcaatcaccaacatcaccacgttggcatcttcaatggcctgcaacgttttgattaccgagaatttctctaccgcatcggtgattttgccgcgtttacgtacgccagcggtgtcaatgagcacatactcacgtccgtcgcgttccattggaatgtagatactgtcacgcgtcgtgccaggcatgtcgtaaacaacaacgcgctcttcaccaagaatacggttagtgagtgtagacttacctacgttcgggcgacccacaatcgccagtttgatcggcagactttgcgggtcgaagtcgtcttcctcttcttcttcgccgttctcttccgcttcaaattgcgcccagtattcggcgtcttcgtcgacttcttcttgcggtgcgagatcttccatccacggcagcagcacgtgctccagcagacttaatacgccacgaccgtgagacgcggcgatcgggtagatttcacctaaaccaagcgcgtagaaatcaaccactgcctgatcgggatccagaccgtcagttttgtttgccaccaggaaggtcggtttttcacgggagcgcagatgtttagcaatcgcttcatccgccggcatcaggcccgagcgcgcatccaccataaacagtacgacgtccgcttcttcaatcgccagcagcgactgttccgccatgcgggtttctacaccgtcttctgtgccatcaatcccgccggtatcaatgcagataaactcacggccttcaatttccgcacgaccgtacttacggtcacgagtcagacccgggaaatccgcaaccagcgcatctcgggtgcgagttagacggttaaataacgtggattttcctacgttagggcgcccgacaagcgcgaccacaggtaccatgtttaaagcctcatttttataaatcatcagacaacgcacgctatattcgtgtcgttgttaaaaacaggaaaacggcccctgtccaggagccgttttcaaagtgaacgacagagacgattaacgtgtaatagagtacacggttccgtcttttgcctggatcagcagtttgccgtcagcggcaaccggttcagtctggaaaccggaactatcaactttttgctgggcaacgaaacgaccatcttcgacgttaatccagtgcagataaccttcgctgtcacctaccaccaggttgccattatacagcaccggagaagtcagcaggcgatgcagcagatcgctttgtgtccacagcgtaacgccgccatcaatggtcaacgccatcacccggtcattttgatcgaccagatagatgcgattgccgtcgacgatgaaatcattcaccgaacccagttcgcgtttccacataatctgaccgctgcgcagatcaagcgccgtcaggttaccattataggccagcgcgaaaacaacgccgttaacaacgacgggagtcgtgtcaacatcgctcagacggtcaatttcggtagaaccggtcgcctgggaaatacgctgctgccaaatcatctggccctgttccatcagcactgcgctgacgcgaccattatcgccacccacgacggccgcaccaaaagccgttgccggcgcagactcgccacgcaaagagagcgaaggcatatcgaggttaactgtccatttgacagcgccgtcagcttcgttcagcgcttgtaactgaccgttactggtgtggattaacaccagaccgtcgctgaccaccgggcgcgaaagtgcttcacccgcaactttagtttgccatgccacagtaccatcgctggtattcagcgcgtaaacctgcgccttttcggtgccaatgtagacatgcccaccagacacggtcacgccgccagaaagtaatgcaggatctttagagaaccagccatctttctcggccaggttgacagaccagatttctttgccgtcatccgcattcagcgcttttactaaaccagcgcggtccgctgcatagacaacgttgtccgccagtgccggatgaagattggaatagaagttgccaatgccgctaccaacggaagtgctccacgcagtagtcggcgtaaactggttttcaacggttggcaatggggacatctttaccacatcttcttcgctgttaaacagcgaacagccgcttaaaagggtaacggaaagcagtcctggcagcagtaatttacgcaattgcatcgggtccctctcagatggacaaattattaattttcatctgcatcatttcgctcagtgccggggtaacatcgcttttcacgcctgcttcccatgcactacgcgcaccttgcttatcacctttgctcagcaatgcttcaccacgcaggtcggcaacaatggcagcccacccttcacctttgatagcatcaagggtttttagcgcggcatcagcctgcttgagctgtacctgaacgcgagcaagacgcagatttatcacggctttgagattttcatcgctcgtgtctgccagcccctgttgtaactgggcggcagctttctctagttcatttttgtcaacaaattgctgcgcaagttccaaagaagccagcgcaccataagtatttttattttcagcagcaaatttttccgccgctgggatgctatccggtttgccttcgctcactgcggtaaccgcattttgataggcaagagaagcggagcgtgcagaatcaacctgatggctgttccagtagcgccagccaatcagtgcgccaacgcccaaaatcaccccaacagccagtgctttgccattttcagcaaaaaagcgtttaaccgcttcaacctggtcgttttcgttctcgtaaatttccacgctgtccttctccttccttaacccagtaacgtgcgcaaatgcgcggctacgctatcctgcgcaactgcagtttgctcaccagagcgcaaatccttcactactgctgtgccgttagccacttcagactcacccagcaccacagcaacgcgggcaccccatttatcagcacgggcaaactgtttcttaaagttgccgccgccgtggttggtcatcagtttcacgcccggtaattcatcacgcagacgctctgctaatgccatagccgcagattgtgtgtcagcacctgaagccaccaggtatatatcgacaacaggatcggctttaaattccggattaacggcctgaactaacaatacaagacgttcgaggcccatcgcaaaaccgactgccggtgttgcacgaccacccagttgttccaccagaccgtcataacgaccacctgcacacacggtgccctgggaaccgaggctgttagtcacccactcgaaaacggtacggttatagtaatccagaccgcgcaccagacgctggtttacggtgtaagcgatccccgcgctctcaagcagtttgcacagaccggcaaagtgctcacgagattcctcgtccagataatcgcctaatgccggagcgtcgttgagaagcgcctgcacttccggattttttgaatccagtacgcgcaacgggttagtgtacatgcggcgtttgcagtcttcgtccagcttttctttatgctgctcaaggaatgccaccagcgcatcgcggtaattcgcacgagcttccagcgaaccgatagagttcagctcaagagttacgtgctcggaaatacccagcgcgcgccaccagcgggcagtgagcataatcagttcggcgtcgatatccggaccttgcagaccgaaaacttcgcagcccaactgatggaactgacgataacgccctttctgcggacgctcgtgacggaacataggcccgatataccacagacgctgttcctgattgtacagaagaccatgctcgatgccggcgcgtacacagcccgccgtcccttcagggcgcagagtcaggctgtcgccattgcgatcctcaaaggtgtacatctctttttcaaccacgtcggtgacttcaccaatcgcacgtttgaatagcggggtctgctctacaatcggcaagcggatttcactgtaaccgtagctgccgagcacgtttttcagtgtgccttcaatgcgctgccagatggccgtttcgccaggcaggtaatcgttcatgccgcgaatggcttgaatgttttttgccacgtttattctctttctgaatataaaaatgaaccctcaacgcttccctcaatgtttcgggagccatgcgggttcaatcatacacgggaagcgaggcgcttcccatcacgttattatttttcaacctgctgaacgtcaattcgacgcgcttcgtccagctgactggctttcgcacgaatgcgtgcttccagctggtcgatcatatcgttgttgtccagacggtctttgcgcacgccatcttcatagaggccgcttttcttgttgccgccggtgacgccgagtgtagaaaccagcgcctcaccagggccattcaccacgcagccgataatcgaaacgtccatcggagtgatgatatcttccaggcgttgctccagcgcgttaaccgtaccgataacatcaaattcctgacgcgaacaggtcgggcaggcgatgaagttgatcccgcgcgaacggatacgcagcgatttcaaaatatcgaaaccgactttgatctcttcgaccggatcggccgccagcgatacgcgcagcgtgtcgccgatgccttcagacagcagcagacctaaaccaatagcggattttactgccccgctacgcgcaccaccggcttcggtgatccccagatgcagcggctgatcgatttgttttgccagcaaacgataagactcaacagcgaggaagacgtcagacgctttcacgctgactttgaactgatcgaagttcaggcgatcgagatgatcaacatgacgcatggcagattccagcaacgcctgcggcgtcggttcgccatacttttcttgcagatctttttccaacgatccggcattaacgccaatacggatcggaatgtttttatcgcgcgcacagtcaaccaccatgcgaatacgctcttcattaccgatattgccagggttaatacgcagacaatcgacgccgtattccgctactttcagcgcaatgcgatagtcgaagtggatgtcagccaccagcggcacgttaacctgctgtttgatgagtttgaacgcttctgccgcgtccatcgtcggtacggagacacggacgatatcagcgccaacacgttccagcgccttgatttgattgaccgttgcttcgacgtctgtcgtacgcgtattggtcatggactgtacggcgatgggagcaccatcgccaatcggcacattcccaacgtaaatacgtgttgattttctacgttgaattggagcctggttatgcatgaaaaatctcccgcgttacccgtctgttactgcgccggtgattgttcggcattgagggtcagacgcgcaacctggttagttctgataaaacgactcagatcgacaggtttcccttgatactggatctgtactgcggctggcgcaccaattttcagtttgtacggtgcctggccggttaagttcaaattaccgtctttacgctgcataccgctaaacagttttttaccggtagcatcggtgacttccagccagcaatcggcagtaaagttcatcaccagcgcattcgggtcaaccgccggcgtggtcacgccagcctgatcggttggcaacggcgcagcgctatctggtgttgttgttgccgctggtgccggagtcgcagcggtatcaacatttgcctgcgaaggtggaacaaccgcattctgttgcggatcaacagctggtgctggcgcagttacggcaggtgtttgcgtgttggttgcggtggtatccacaggtgatgtcggcgtggtcgccatagcctgatctgtggttgtcgacgtatctaacggtacactctggctttgattattattcagttccgcagaagattgatcggccatagtggtgatctcttcctgctgagctttgtggtcttgccaccaccaggcaccgctcaggccaataaccacaaacaacaccagccaggtgaaggtcatcagccagccgtcacgttttttgcggcgtttaccgagggaaaaactctgcatcggcgcaacttttgcagcccgtagtggagcctgcttttccagccctggcagcagttcttcttctggaatatgtaccagacgcgcataagagcggatatatccgcgcaggaatgttgaagcaagatcggcgggtgccttatcttcttcaatgtcgcgtaccgtggaaaccttcaggcaaagtcgctcggcaacggcctgttgactaagtcctagttgttcgcgagcattacgcaggcgagcgccggtagtaagtgcttcattttggtcgtgcgtggcttcagtattcattcgctgcaggtacgtttaaatgagaattgagatgccggtgaaccatcatgcccacccacaccgcgaaacatccgttaagttaaccgttatcatacagtataagaccgtctgtgtgctcgtgacaaagcccacattcgctaaggctaacttactgttgcatcgttacatactgccttaaagtcagcaaaaacgcaccgttaatattgaccagacaattgcaacttaatacttcattcataaaagattacgccacggtacataaagtaaccctggcgtaatggctatcagaccgctttaatgtcgatggcttcaccctgcatccgcttacgcagagtacgtttcgtacggtcgataacatcgcccgccaactgaccacaagcagcatcgatatcatcaccacgagttttacgcacaatagtggtgaaaccgtagctcatcagcacttttgagaaacggtcgatacggctgttcgaactgcgtccatacggcgcgcccgggaacgggttccacgggatcaggttgatcttacacggcgtatctttcagtagttccgccagttggtgcgcgtgttcagtgccgtcgttaacgtggtcaagcatcacgtattcaatagtgactcggccctgattggcgttggatttctccagataacggcgcaccgccgcaaggaacgtttcgatattgtactttttgttgatcggcacaatctcgtcacgaatttcgtcgttcggcgcgtgcagggaaattgccagcgctacgtcgatcatatcgcccagtttatccagcgccggaaccacaccggaagtggaaagcgtgacgcgacgttttgacaggccaaaaccgaaatcatcaagcatgatttccatcgccggaacgacgttgttcaggttgagcagcggctcgcccatacccatcatcactacgttagtgattgggcgctgaccggtgacttttgctgcgccgacaattttcgccgcacgccacacctggccgataatttccgatacccgcaggttgcggttaaagccctgctgggcggtggaacagaatttacactccagcgcacaccccacctgcgaagagacgcagagcgtggcacggtcgtcttccgggatatataccgtttcaacgcgctgatcgccaacggcgatcgcccatttaatggtgccgtcagatgaacgctgttcttcaaccacttccggtgcacggatttccgccacctctttcagtttgccgcgcaacactttattgatgtcggtcatctcatcaaagttgtcgcagcaatagtgatacatccacttcatcacctgatcggcgcggaagggtttttcacctaaatctttaaaaaactcccgcatctgctgacggttgagatccagcaggttgatttttccatctttcgtggtgacgttttcaggtgtgactaattgttcagacatatgctattccggcctcgttattacacgttatggcccctggagggttgaaaaaagaaacgccccggtgagcggctgctcgtccgggggcgctgcattgtacaaattctggcgcacggatgccacgtttgcacgcggcatttacgaaattattaacgggtgcgcgggcacacttcgccttcgccgaagaaataagcgatttcgcgagcggcagattcgacggaatcagaaccgtgggtaccattttcggtcaggctgtcagcgtaatcagcacgcagagtaccggccagtgcatttgccggattggtcgcgcccagcagatcgcggtgacgctgaacagcattttcaccttccagcacggaaacaacgatcgggccagaagtcatgaattcaaccagaccatcaaagaacggttttccatcgtgttcagcataaaagccacgagcctgttcaacggtcaggtgcagcattttggtgccgacaattttgaaccctgcagtttcaaagcgcgcaaagatactaccaatcacgttttttgctaccgcgttcggtttgatgatggaaaaagtacgttcaatagccatttttacctctgtaaattgttctgttgttgtctgtaccagcgtacgagatggcgcggattataatgagcaacagggccgttgactattgatgaaggtaacatttttttaaaataaacccagtttaagcaacaatcagggacaaaacagactattgcatgacaaatttcactgtcgctatttgccccacgtcatccatcaccagcaattgataatcgcctttatccgtcaaatgcagggtcacgttgcgcccacgttcagttaacggttcgccattcagaaaccaccagcgttcacctgcccctccacttgattgcaacggcaaagtcgcttccgctgcgcccggtaaacgtttaataatcgcgccatcgcgcacacctgttagctgcagcgggagttgtgcatcgtgaccgtatggcgggcaaattgtcgaggccggtggcaagcgcacagcgcgacgttctgatgcgggcagccagggttccagcggtagcggccagacatttatcatttcttgtcgcgcctgagggcaatcagcggcaacacgtttgccgttttcatccagccagatggggaaacgaatgccattaatgccttcctgctccggcagtaatagagttggcggctggctcccgtccagcagccaggttgccaggcggcggcgacagttaccgtcaccttccggcaaagactgtccgcccggccagcagataacgccacgacttacagggtcaggacgtgggtcttccggcaaattcacactgcgcgacagtaagatattattaacctgattcaacagcggtacggcactggcaaagccaaactgaccaacaacgggcgtgccgtccggtctgccagtccagatcccaatgacatagcgagcgttaaccccaatcgcccaggcatcacgatagccatagctggtgcccgttttccatgccagtggggcgacgcgcggcaaggcaccatccggcaagggttgcgcttcatcagccataatccggcgaatgatccacgcagcccccgacgacattaaaggccgttcaagcagcggatcgtcaggctgtaagcgcaatttacctgccttgccgtggcgagcaaacgcggtataggccgccgccatatcttccagttttgcaccagcgccgccgagaatgagcgaaagattcggcgcagcaccgttgggcagatacaacggcaatccaacattgcgtaattttgccgcaaaccgtttcggtccataggcttccagcacctgcacagctggtaaattcagcgagcgcaccagcgcctcgctcatgctgatcgggccatgaaaaccgctgtcaaagttgccaggtcggtaatcaccggtacgccgggggacgtcttgcaacagcgatgccgggtggatcaagccttcatccagcgccagaccgtaaacaaacggtttgagcaccgatcctggcgatcggatcgcattgaccatatcaacatgaccaaagcgtgaatcatcgttgagatcaactgatcccacccagccgcgaacacgcatatcggtatgatcaaccacgatcatcgccagtgagctgcgcggtggcaatcgtcctttccagttttgcgccagttcttccagacgtcgttgaagaccggcatccagcgtagtaacgattttgtcgcttttgcttttaccgagcatcatgcgcgaaaacagcggtgccagttgcggcatttgtcggggtgccagccagatgggttcttcccttgactcttttacccgctcacgggaccacacaccttgcacggccatccgttcgagcactttattacgcgcggcttcggcacgctccggccaacgatccgggcgaagacggctgggcgcttgcggcaaaaccgccagcattgccgcctcggaatagcttaaattcgcaggcgatttcccgaggtaagcccaacttgccgcaccaatcccctgcaacgtaccgccaaacggggcacggttaagatacaaggtcagaatttcacgtttagacagatgccattccagttgcaacgcgcgccagagctggcgaattttgccgccaaacgttttggggtgaggatcaagcaggcgcgccacctgcatggtgagcgtgctgccgccggaaatgacccgacccgacgtgagatcttgccaggctgcacgcgccaccgagaacggattcacccccggatgcttccagaaccagcgatcttcataattgatcagcgcttcaaggtaacgtggagaaacatcttcgattgttaccggataacgccagatgccgtcagcatcggcgaaacgccagagtggcgtaccatcctgcgccaccaccacgcgtgcaggattcacttcttgcaatggcagaggccagagtttatctgctgcccatgctgccagaatgatgataaaaggcgcggctgccagcattatccagcagccgcgtttggttaacaggcgaggcatttacggtctgactatcaacagatcgtcagccgcaccagtcgcccgccattgaggaacatacattgattccaccataggctgcggcacctgatacgttcccggcgtcaccgcccgcgccagatacaccagcgttaccggttgatattcatcaacggcaaccgccgccacaaagcgatcgtcacggaactctatgtgcttaatgctcgcctgctgcatctggttcagcaagttctgcacttcaccaccactttgctccaggctggcgctgccgttcgccagattctggttttccagttccagccccgcaggcaacagatccacgactaacgcatccggtacactgttactggctttaacctgcaaccacaccagcaccagatcgccgctacgtaacgagtccagcgatttgctcttaccgtcagtacccagaatatgacgctcaatttgcagcacattgctcgccggtaaaggtgcggattgcggataaccgctggcatccacacgcagccataacggctgatcgccactgttggtcacctgcaaggtggcaagttgatcgctattcagattgctggtttgcgctttctcgcctgtcaacggctcagcagagaaagtggtttgcgcctgccatttgcccggtaaatcctgaagagtacgggcagccaggaacaacgcgttactttcctgcgtcgatagccagcgttcaccgaacgcctgctgcgaaagtgtgtttaacagggagtactgctcatcgggtagcagtttgttctcttccagcaatgagagcatcaacgcgctgtctcgcagtggactaccgtaatcacccagccatatccgctcatcactattacgcggcgttttcagcgccagcgcaatcgcttcttcaccacgcgtcgcatcacccatgattttcagcgcaacgccaagttgcagcagcggtaaaccagaagcggcatctgcacgatgctcccagatttcacgcagcgcacccagtggtgctttttgctgacgggccaacaccagcgcagcgtaagactgtacggcgaatttactggctttgagattatcagcgtacgggatcgacatcatgcccggatcttgtaaatagcgcagcagacgctcattaccccggttaatggcgtctgtcggcacgctgtaaccctgttcgcctgcgcggaccaggaaatccatcacgtaagccgtcagccagtactcttcgtcaccgtttttatcccacaacgcaaagccgccgttatcacgttgcatttgcagcaaacgggaaatgccgatatcggccgatgcacggcgtttctcatcactgtcgcctttgatgcccaacgcctgcagttgggctgcattggtataaagtgacgggaacaggccgctggcggtttgctcgagacagccgtacggatacgcttttaactctttgatataacgtgcgatgttcagcggtggtttgccactcaacaacaattgcccttccagcgtaacaggcgagaagttttgcaatccatcagccgggagcgcccaggtttcaccaggctgtaacgccgtaccgtaattgaccgtttgtgccgggaatgccggacggacgccgattttccactgcttatgctgatcggcaacggtttcccccggtaacgctaacccgctaatggtggcctgaatgtctccatcgccataacccggcaatgcacgcaccgggataaacagcgtagtacgcacccctggcgctaattcaacaggtgcgggggaattactcaccagttcaagcaagccactggcggtcagagcaacattaagtttttgcggtttatcggtaagattagtgatatccagcgtcaggcgcgaggtatcgccactcgccataaagcgcggcatgttcagttcagcaatcaccggtgcggcaacaatcactttgctttcgttgcttccgaagtcatctgccgtccaggcttgcgccatgacgcgcaattcaccgttaaaatcgccaattggcagtgtaaccgagccttcgccctgttcattgagcgttaccggcagcgcctgctgcgcgacaatattgacgtgattgaccggcggtttaccaccacgtttcagctcatcaccatcgccaccaaaacgcagagctgccagacgcccctgaccttcaatgacctgaccgtaaatatcgtaaatgtctgcgccatagcgtttctgaccaaagaacgcctgccacggatctggcgtgacgtaatcagtaatattcagcacaccgctatcaaccgcagacaccagcacattcacctgttttggcatctcaccatttttattgctggctttaattttcacggttaatggctgattggggcgcattttggtaggggtttccagcgccagatcgaggcgacggttttcatcaccaagcggcagatgcaacaccccaaccgcgcgttttggcgtcgcggagcgagatttatcgccaggacgtaccaccagcgtacttaaatacagatcatgacgattccaggttttatcgaccggaatcgtcagatccagcccttgagccggaacatcaatctcttgccaccacagcggcccttcactggactcgaccatcgcataacctttacccgccgttggcgcggcaatatgcaacttaatggtatcgccagggcgatagctggctttatccagtttcagcgtgacacggtcgggtcgcactgcaccacccccgtcgctgttatcctgccagctataaccagcccagaaacgcacactactgaccgcttcattcggcgctttaacttccagacgataagcgccccactctaccgggaaactgaccttaccggtttcgtccgctttcagatccagagtttgttcattttcgatcagatctttttgatcaaactgtgactgccagccttcatattccgaccagttccagtagtaatcgcggcgttcgcgaatcaggcgcacctgcaagcccgacacggcttttttcacgccttgcgcatcgctataaacgatgtcaaaagcggcgttactaccttcatcaacaatgggctgtttcaccgtgctgtcggtgcgataatcgtaaaccgatttcgaggcgaactgcggacggatccctggcaatgcatcagcaggccagatagcctgctcagcacggcgcgtcaccgggcgaccgcccgattccagcaaactaccctggaaaataacctgtaatggggaatgtgtttccttccactggctttctgtagaaacttcgccgcgccctttatcatccagcgtcaactgaacttcatccagcgtgcgggaaagattttcggcagctatatcgccgaattcaaaaccaggtaaggctgacacagcttcacgcagtgggcgcaggaaaagttgcccttgcaaagtattaccattagcaggtgcaccatacaggtagtaccccaccacggagaatttcacttcatctttcggcgttagcggggttttctcaccggtcagattcagcgccatacgctctggcataaaatcttcgacgtggaaatcccacatccgatactggttatcgcccgtgttagcgcgaatatgccacataccggttgccgcattgctatcgagtggccaggtaaagtggtagaggccattctccggctgactaacgacgctcctgagtacctgcccgtcgggtttaatcacgtctaacttgatgggttgatcgggcaatgctttaccgtctgcatcacgcagcaaaccattgaggatgaccgtttcacccgggcgataaagatcgcgcgggccaaacatgaaaaactgtttgctatagcccggcgcgccagcaatgttaaattccgctaagtccagcgccgggagttttaaatcgagcagcgttgtctgaccgtttttacgcgccagcagtaatgccgcgtttttatcattttccagctgcacatgcccctgagcgtcactgcttgcctgagtcagagtctgccctttctcatttaataaagagacttcaattccttgctgggccgcgccgttttccagactttgggtaaagatatccagacgattgtgataacggtgagctgaaacgccaatatcacttaacgtaaacagcgtcgcgggattactgtaatcgtaacgtccagcctgattcatcacagccagatacacgcccgcctgctgaagcggtttgatatcgcccagcggcagcaataatttttcacgggtgttacgcgcaggattgagatcaaaccgtccggtgtagaccagatccgccatctgcagcagtttatctgactgccagttcgccagcgaattgcggtattcccactggctaatgaaagcgggcagtgattctggtttcacacggaagaagttaacatcgacattgttaacgttaagcgccattaccggcagcccttcaacgaccttaccaggaagcaacgaaccacgactggcaaaaccgacgctgggttggatatcgcgggtagttatagttttttcgtcatctttactaaaggttgcgttattgagcgctttgacctccttgccaatagtgacgatcaaatcacgtttcggttcgaggtggcgtaaacgcagctctttaagattatgtgacagctcccaggcaccatccactttgccgctttttttatcgacgacatgaataacgcgtgagaaatcctgatccgggtcgagagggatggagaacgtcagcaccagcgtggctgcgccatcgagttgaacttcagagagatccagcaatgtcagcgccttaccggcactctgttgggccagtttttgtcgctccggcgcggaaagttttgctgaactcacgttttctgaagaggccgctttagtaacttcagaaggcgcatcttttttcaccgctgttggcgcgttatcgttgttgtcgcaccctgccagcgccagcattagcatgcaggcggctacgcgtaactttttcatttttcatccctgccacaatggcccgttagcaacgtcgaataattattatgcgtgagaatttacgttatgtaattcagtatcacgcccatacaatccgaattttagtgagaattgtggctcagacagccaaatcagcctcttttgcttgtcgcttttcactaaacatccgacaatttagcctaaccccggcaaaaatggagatgcctatgtccacgacatggtttgtaggagccgactggctcgccgaacatattgatgacccggaaattcagattatcgatgcccgcatggcgtcgcctggacaggaagatcgtaacgttgctcaggagtatctgaatggacatattccaggcgcagtgttttttgatatcgaagcgctttctgatcacacttccccgcttccgcacatgctgccgcgcccggaaacgttcgccgtggcgatgcgtgaattaggcgttaaccaggataagcacctgattgtctatgacgaaggtaatcttttctcagccccacgagcatggtggatgctgcgcacctttggtgtagagaaagtgtcgattctgggtggtggacttgcaggctggcagcgtgatgatctgctattagaggaaggcgcagtagagctgccggaaggagagtttaacgccgcgtttaatcctgaagccgtggtgaaagtaaccgatgtattattggcaagccatgaaaatacggcgcaaattattgatgcccgcccggctacacgttttaacgcagaagttgatgaacctcgcccaggtttacgtcgcggacatattcccggtgcattgaacgttccgtggacggaactggtacgtgaaggcgaactaaaaacgaccgatgaactggatgcgatattttttggtcgcggtgtcagctacgacaaaccaattatcgtcagctgcggttctggtgtaacagcagccgtggttttgttggcacttgcgacgctggatgtgacaaacgtgaaactgtacgacggcgcatggagtgaatggggcgcacgggcagatttaccggttgagcccgtaaaataagctttttacaggcaataaaaaaccgccgaatctggcggttttttattgctggtctggttcgcggcctttccagcaggttgtattaccgtagtaatgcaagcgcgtctcagcggacacaatactcgccagtaactctctttttgtcaagtaaaagagagttattattgttctgttagtgtattatccactgcggccctttccgccgtctcgcaagcgggcgctggcttaaggaaaggatgttccgcgaccgttagggcaagcgcgtctcagcgcttgctatcgcggcaatatcgccagtggtgctgtcgtgatgcggtcttcgcatggaccgcacaatgaagatacggtgcttttgtatcgtacttattgtttctggtgcgctgttaaccgaggtaaataataaccggagtctctccggcaacaatttactggtggttaacaaccttcagaacagcaagtaagcccgaatgccgccctttggggcggcatgttttaaattatccggttctgtttaaagtcacgcaaaaaaccaccccagcgacgttcatagaatggcgcaatatgttcggtaataaagtggctaatacctttttccccttttttcacctgacaaatatcgatgggttcatcgccaggtaatgtatcggtcgctacacttcccgccgcctgaataatttcttcgatatcaccatcggcttcaatgccaataagtaaattaggctgtgcctcttcgttctctttaattgaacaaataaaagcacgcttcaccggcttaatggttttaaataaggtggtaagtgaatcaatcatttgcgctggcggctctgcgacctccgataatatcagcgattcaccgccttccagtacttcctggctactcagcggattcccttcttcaccaatcaacaaactgatttcacgcggcataaactctttaccggttggcagtttggcattaaggaagagcgtttcgccaagggtcatctcaaacaatgtgcgaacgggcattacgacaaatgcctgttcgtcttcaaccgcctgttgaagtgcttctaacgaggtaaaaaaaggaatgacgctggtgccgtcttctttttcccagtgctgtaaatcaagcgcgctatcttcaactactgcctcgccctgcgccgccgtaccaggcacccagacggtggattccagtagagtacggaaaaaggccgggcggtgagccggttcggttgctgctttttccagcaggtcttcaagttcgttttttgtttcggacataagaaccacaattcattcaacgttcggggagcaagtgcctgatgcgccacgcttatcaggcctacaagggagtcgcaatctattggattttcgcaatttgtaggccggataaggcgtttacgccgcatccggcatattagtttacgccgttaacagattagcaatcgtgcgcacaccaagtcccgtagcacccgcagaccactgttcaaccggcgctttacggtaagtcgccgagcagtcgatatgcagccagccttgctgatagttctcaacaaagtgcgacaggaagcccgccgctgtgctcgcgcctgccggatacgccgcgcttccggtgttgttcagttcggcaaagttagacggcaattgattgcggtggaactccgccagcggcagacgccagaacggttcattctcctgcgcggcactcgccaacaagcgaccggcaagcgcatcgtcaaaactgaacagcgcgtgataatcattacccagcgcggttttcgccgccccggtgagggtcgccgcatcaatgatcagttccggtttctgcgcactggcatcaatcaggccatcggccagcaccagacgcccttcggcatcagtgttcatcacttcaacttttttaccgttgcgataggtaataatatcgcccagtttgaacgcgttgccgctgatcaggttatccgcacaacagaggaacagcttcacgcgcttgttcagtccgcgcgtaatggcaaatgccagcgccccggtaaccgttgccgcgccgcccatgtccgacttcatcgagtccataaacgcagtctgtttgatgctgtagccgccggaatcaaaagtgatgcctttaccaaccaggcacgcgtacactggcgcttctttatcgccagttgggttgtaatccagcgccagcaataccggagaacgttctgaaccgcgcccgaccgtgtgcagccccatataaccttgctcacgcagatcttcgcctttggtgatccggtaagtcacacgatcccctgcgacgttgctgatcagatcaacagcacgctgtgccagttgcgatggccccagctcttctgccggtgcgttgatggtgtcacgcacccagtcgatgatcatcaggcggttatccagttcctgacgctgggcatcgtccagatccggccactccactttacgtatgcctttcggggctttgtaaccttgccagaatgcccagcagcgatccgcatcccagccttcaccgcttaactgaacatgcttgatgcccagaccgtcaatcttgcgcgccgcacgctggatcaaccccagatcgtctgccccgttcaaatgcagggtaatgccatcattattaatgctgtaagtcgctttttctccccaacgtgcgtcggcaggttggggagagagggtaatcttcatcgcttctgtcattttagttatccttattcgtttaacagcaaaacgggctacccccaggcagcccgttcattcactcggcttcgtccagccagaccaacaaaatcgcttcgaggattttctcgttcgatgcctgcgggtcgtcgtcgaaatcttccagagcgcaaatccactgatgcatatcggtgaatcgaaccgttttcggatcaatatcgggatacgcatcgtacagtgcttcgccaatttcgcggctatcggtccacttaagtcccatactaacctctgttaatgctcacgcgcatggttgatagtgtaacgcgggatttcaaccactaaatcttcgtcggtgacgcgcgcctggcagcttaaacggctttccggctccagtccccaggctttgtccagcatgtcgtcttcctgctctgagctttccggcagcgagtcaaaaccttcacgaacgatgcagtggcaggtggtgcaagcacaggatttttcacaggcgtgttcaatctcgataccgttacgcagcgcaacgtcgagaatggtttcaccgctattcgcttccagaacagcgccatcagggcagagatcctgatgaggcaaaataacaatctttggcatattaaacctcgtccacggaatggcctttcagcgcacgacgaaccgactggtccatgcggcgagcggcgaaatcctgggtttgtttgtctacgtttttaatcgcttgttcgatggcgtcaacatcatcgccctgcgccacttcactcaggtgagcagcagcatcgtcaatgacctgacgttctgcggcgcttaacagcgcggcatcagcagccagcgcaccgtgcagactttccagcacacgcgccgcttctactttttgttctgccagcattcgggcttttacgtcctgctcggcatagctcattgagtctttgatcatcgaggcgatttcgctatcggtcaggccataagacggtttgacctgaatagacgcctcaacgccggtggatttctccatcgccgtcacgctcaaaagaccgtcggcatcgacctggaacgtcacgcgaatatgcgcgccgccagccggtagcgccggaatacctcgcagcgcaaaacgcgccagcgagcggcagtcctgcaccagttcgcgctcaccctgcatcacatggatagacatcgccgtctgaccatctttaaaggtggtgaaatcctgggcgcgggccaccggaatcgtggtattacgcgggatcactttctccaccaggccgcccatcgtttcgaggcccagcgacagcgggatcacatccagcaacagcatttcgctgtccggcttgttacccaccagaatatccgcctgaatcgccgcgccaatagcgacgactttatccgggtcgatagaagtcagcggtggacgaccgaaaaattcgcctactcgttcacgcaccagcggcacgcgagtagaaccgcccaccatcaccacttccagcacttcatcagcttctacgcccgcatctttcagcgcgcgacgacaagccagtaaggttcgttttaccagtggcgcgatcagttcattgaattgttcacggctgatttcgccctgccagcccgcaacgttaacggtcacagagtccgcatcgctcagcgcgattttggccgcaatggcagcatcgagcagttcacgctgaacgcggttatcgctacgatcaggaatgcccgcctgctcgcgaatgtaatccgccagcagatggtcgaaatcatcgccgccgagcgcggaatcaccaccggtcgccagcacttcaaacacgccgcgacttaagcgcagaatggaaatatcaaacgtcccgccgccgaggtcataaacagcgatcacgccttcctggccggaatccagcccgtaggcaatagccgcagcggtcggttcattaagtaagcgcagaacatgcagccccgccagacgcgccgcgtctttggtgccctgacgctgggcatcgtcaaagtacgccggaacggtgataacgacaccatccagctcgcctgccagggcttcagttgcccgcgccgccagtgctttgaggatgtccgcagaaacgcgcaccgggttcagcagccccgccgccgtttcaatcatcggcaggccattttcgctggcctggaattgataaggcagatgcggatagcgttgctggatatcagccagcgagcgccccatcaggcgtttaacagaactaatggtgttggcggtgtcgagcgctgcgttagtacgcgcgtcataacccaccgaatgcccttgctgttgatagtgaacaacagatggcagcaggtgacggccttcatggtcagctaacgtttcggcctgaccgctgcgcactgttgccaccagcgagttggttgtgcccaggtcaataccggccgccaggcgacgctgatgcggcgcagcactcaaaccaggttcactaatttgtaataaggccatgtttagcttccagaaattaaaaatcgagcagtttttcttcgagttgttcggcactgctccgcagtttatcgagaaaacgcagcttacgcacggtatccgccgccgcgtcccacgtctcgttgtctaactgttcaaccatcaactgatggcgggtatcaaacatctttttcacacgtttgataaagctttccagccgcgcttcatctttcgcctgttcgatctcgtccagttcttcgcgcagttccagctgttccatcaggaacgcggtgtcgcgcacagtatgctgctcgctggcgagatcaaaaccgtgcaaagaaagcaaatattccgcgcgcattaacggatgacgcaacgtttgccaggcctggttaatggtcgcggattgctgtacggcggcgagttgttccgcctggcttccgctggcgaatttatcaggatgatactgacgttgtagatcctgaaaacgcaggctcagcgcctgggtatcgagttgataacgggcaggcaagccaaagagggtgaagtaatccataacattctcagggctgcgatccgccgcgataacggcgaatcaggtaaaacaaaccccacgcgcaggcgaccacggtggggttatcggtatgcgcatcaaacgtggaagctttcgccgcaaccacactcatctttgacgttcgggttggtgaatttaaacccttcgttaaggccttctttgacgaagtccagctgcgtaccgtccagaaattgcaggcttttgccatcgaccacgactttcacgcctttgtcttcaaacacgatgtcttccggcgtcggttcgtcaacaaattccagtacataagccatacctgaacacccggaggttctcacgcccagacgcaggccaaaccctttaccgcggttagccagaaaggtatttactcgcgctgctgcactgtcgctcagtgtaatcgacataaccaaacctcaactcttattttgcttcacgtttgcttttatagtccgcaatggcggctttgatcgcgtcttctgccagaatagaacagtgaattttcaccggcggcagttcaagttcttcagcaatatcggtgtttttgatcgcctgtgcttcgtcgagagacttccctttcacccattcggtgaccagggagctggaagcgatagcggaaccgcagccgtaagttttaaaacgcgcgtcttcaatgataccttcatcgttgactttaatctgcaacttcatcacgtcgccacaggccggtgcacccaccatgccgctgccgacgttctcgtcgttgttgtcaaaggaacccacgttacgcggattctcgtaatggtcgataactttttcgctgtaagccattataaattctcctgattccgataccgattaatgatgagcccattcgatgctgttcagatccacgccctgcttgtacatttcccacagcggagaaaggtcacgcagacgaccgatggatttacgaactaactcgatggtgtagtcgatctcttcttcagtagtaaaacgacctaaagagaaacggatagagctatgtgccagctcgtcgttcagccccagcgcgcgcagcacgtaggacggttcgaggcttgctgacgtacaggcggaacctgaagaaaccgcgaggtctttcagcgccataatcagcgactcaccttcaacgtagttgaagctgacgttgagaatgttcggcgcaccgtgttccaggtcaccgttcaggtaaacttcttcgatatctttgatgccgttccacagacggttacgcaggccgcgcagacgttccatctcggtcgccatctcttcttttgcgatgcgataggcttcgcccataccgacgatctggtgaacaggcagagtgccggaacgcataccgcgctcgtgaccgccgccatgcatttgtgcttcgatacgtacgcgcggtttacgacgcacatacagcgcaccaatacctttcgggccatagattttgtgaccggagaaagacatcaggtcaactttcaactggctcaggtcgataggcagtttgcccacgctctgggttgcatcaacgtgatagataatgccacgagcacggcacatttcgccgatagccgcgatatcctgcaccacgccgatttcgttatttacgtgcatgatggaaacaaggatggtgtcgtcacgcatcgctgcttcgagttctttcaggtcgataatgccattacgctgcggtgccaggtaagtgacttcaaaaccttcgcgctccagctgacggcaggtatccagtaccgctttatgttcggttttactggtgatgatgtgcttgccttttttctgataaaagttggctgcacctttgatcgccaggttgtcagattcggttgcaccagaggtaaagacgatttcacgcggatcagcgccgaccagatcggcaatctgattacgggcgatatctaccgcttcttcagcctgccagccgaaacggtgagaacgggaggccgggttaccaaaggttccgtccatcgtcataaactgcatcattttctcggcaacacgcgggtccaccggcgtggttgcggagtagtcgagataaatcggtaatttcattgctctataaactccgtacatcactcaatgcaaggaaccaggctaccggctggatgtacgaccgtgtttacggagtgtttagcactccggcctgattctgaattctttttattaagcgcgtaacttaacgtcgatcgcgtcttgtgtgcgggtgcgtggcgcgtcgtgagtatgctgacgaccagacacatccagcacttcctggttattaaccagttcgcctaaagtaatgttattgagaaaaccggtaagacggtcgctcaaatcacgccacagcgcgtgggtcaggcatttatcgccgccctggcagccgcctttaccctgacaacgggtggcatctacagattcgtcaacggcgctaatcacttcgccaacggcgatgctgctggcatctttgcctaacagataaccaccgcctggtccacgtacgctggaaaccagaccatttttacgcagacgggaaaacagttgttccagataagaaagggaaattccctgacgttcggaaatatcagccaacggtaccgggcccgcttcagagttgagcgcaacgtcaagcattgcggtcacggcatagcgccctttagatgtcagtctcatgtcttacttcacctcaaactcgcccctgcccggggttttttattgtaaaagtgggggtattgcatagcagggtcaagtctgacattcccgagtaaattggtcaactatttacttgactgatttagtcgggtatttaaccttcagtgccattttttatcgtggcgtttgtacctgttgtcggatgcggtgtgaacaccttatccgacctgggattccgtgcacttacaggcctgataagacgcgttaagcatcgcatcaggcaactactgttattcggccttgttacctttattctgctgctcaatagaagccagaatcccgcgcaggatattcaattcctggctttccgggcgtgcacgggtaaacagacggcgcaatttattcatcacctgccccggatggttttcacggataaaaccggttgccagcagcgtttgctccagatgaccataaaaacgctccagatcatcgaccagcggatacggcgtctcttcatgctcgacctgctcgccattttcctgagttgccagccaggccatgcgcacttcataggcaataacctgaaccgccatcgccaggttcagcgaactgtattccgggttagccgcaatcgcgacatgataatggcatttctgcaactcttcattggtcaagccgacgcgctcgcgaccaaacaccagcgccaccggggtatttgccgcttcagcgacgcttttcagaccgcattcgcgcgggtcgagcatcggccacggcagcgtgcgggagcgagcgctggtgcccaccaccagactacaaccggctaacgcttcgtcgagcgtatcgacgatgtgagcattaccaatcacatcgctggcccctgctgccagggcaatcgcctgggagtctggtttcactagtggattaaccagccacagattggttaatcccattgttttcatggcacgggcaacagaacccatattgccggtgtgtgacgtctccaccagcacaattcgaatattttgcagcattgtctttcttcatctaaagattattcacgcatcttatcataaaacgaagacagatgccgatctcgctgctatactctgcgccgttttcccgttctttaacatccagtgagagagaccgatgcatccgatgctgaacatcgccgtgcgcgcagcgcgcaaggcgggtaatttaattgccaaaaactatgaaaccccggacgctgtagaagcgagccagaaaggcagtaacgatttcgtgaccaacgtagataaagctgccgaagcggtgattatcgacacgattcgtaaatcttacccacagcacaccatcatcaccgaagaaagcggtgaacttgaaggtactgatcaggatgttcaatgggttatcgatccactggatggcactaccaactttatcaaacgtctgccgcacttcgcggtatctatcgccgttcgtatcaaaggccgcaccgaagttgctgtggtatacgatcctatgcgtaacgaactgttcaccgccactcgcggtcagggcgcacagctgaacggctaccgtctgcgcggcagcaccgctcgcgatctcgacggtactattctggcgaccggcttcccgttcaaagcaaaacagtacgccactacctacatcaacatcgtcggcaaactgttcaacgaatgtgcagacttccgtcgtaccggttctgcggcgctggatctggcttacgtcgctgcgggtcgcgttgacggtttctttgaaatcggtctgcgcccgtgggatttcgcggcaggcgagctgctggttcgtgaagcgggcggcatcgtcagcgacttcaccggtggtcataactatatgctgaccggtaacatcgttgctggtaacccgcgcgttgttaaagccatgctggcgaacatgcgtgacgagttaagcgacgctctgaagcgttaatgactcaggcgggtgatatcactcacccgccctcgcctttcaggcgctattccgaaatacttcctcaccgctttactttctttcgtcactctcccaccatctttccccgattaatggatgataaagaagtcgcaaggaaagattatggcgctgccagtgaacaaacgcgttctcaaaattctgtttattctctttgttgttgccttctgcgtttatttagtgccgcgcgtcgccatcaacttcttctattatcctgacgataaaatatacggtcccgacccctggtcggcggaatccgtcgaatttacggctaaggacggtactcgtctgcaaggctggtttattccttcttcgacgggccctgctgacaacgccatcgcaaccatcattcatgctcacggcaatgccggaaatatgtccgcccactggccgctggtcagttggttacccgagcgtaatttcaacgtttttatgtttgattatcgcgggtttggtaaatcaaaaggcacgccgtcccaggccggattgctggacgatacgcaaagtgccatcaatgtggtgcgccatcgcagtgatgtaaacccacaacggctggtgctgttcgggcagagtattggcggggcgaatattctggatgttattggtcagggtgatcgtgaaggcatacgtgcggtgatcctcgactccacctttgcctcttatgcgaccattgccaaccagatgatccccggcagtggctacttacttgatgagagttacagcggcgaaaattacatcgccagcgtcagcccgatcccgcttttactcattcacggtaaagctgatcacgttatcccatggcagcacagtgaaaagttgtatagcctggcaaaagaaccaaaacggttgatcctaatcccggatggcgaacacattgatgctttttccgatcgtcacggcgatgtttatcgcgaacagatggtggattttattcttagcgcgttgaatccgcagaactaacccatgatcgctagcacgataatcattcacaaaaccaccttaagacatgctaatccactggtcagaacagtttaaaatgagaaaaattctgtgatgcttgccaacatttctgatgattagcattcccttcgccatttccctgagcaaactttagctattcttatcaattatgcttatgggagatctacagatgatgcctacgcttgctccaccatctgtcctttcggctccccagcgccgctgccagatcttgctgacgctctttcagccggggttgaccgccaccacggcaactttcagcgagcttaatggtgtggatgatgatattgccagtcttgatatcagcgaaacaggacgggagatcctgcgctatcatcaactcacactgactactggttatgacggtagctaccgggttgaaggtacagtgcttaaccaacgtttgtgtttatttcactggctacgacgtggtttccgtctgtgtccgtcatttattaccagccatttcacccccgccctgaagagtgaactgaagcggcgcggaattgcgcgtaacttttacgacgataccaatctacaagcgttagtgaatctctgctcccgacggctgcaaaaacgctttgaaacgcgcgatattcatttcctgtgtctgtatctgcaatattgtttgctgcaacaccacgctggaattacgcctcagtttaatccgctccaacgtcgctgggcggaatcctgccttgaatttcaggtagcgcaggaaattggacgccactggcagcgtcgggcgctccagcctgtaccgcctgatgagccactgtttatggcattacttttttccatgttgcgggttcccgatccactgcgggatgcgcatcagcgggacaggcaactgcgtaagtctatcaaacgtctggtaaaccactttcgtgagctgggaaatgttcgtttttatgatgaacaggggttatgcgatcagctttatacccacctcgcccaggcgttaaatcgcagtttgtttgccatcggtattgataacaccctgccggaagagttcgcccgcctgtatccacgcctggtgcgcaccacccgcgcggcgctggctggatttgaaagtgaatacggcgtccatctttctgatgaggaaagcggtctggtcgcggtgatttttggtgcctggctaatgcaggaaaacgacctgcatgagaaacagattattctactgaccgggaatgatagcgagcgagaagcgcagattgagcagcagctacgcgaactaacgttactgccgctcaacattaaacatatgtcggtaaaggtatttttgcagacaggcgctccgcgcggcgcggcactgattattgctccttataccatgccgttaccgctcttttcaccaccgctgatctatacggacctgacgctgacaacacatcaacaggagcagatccgcaaaatgctcgaatcagcatgagggaacaactttcgggcgcaaaaacattgccggaagcgccaccagcgccatcacccagaacacgccgtggccgagatattgatacaggaaaccggcgaaaacggtcatgatggcgatactgccgcccatcgcgacggcagagtaaaccgcctgtaaacggatgacttcgctaccctggcgagcagcaatatagcgcatggcagccaggtggcagaccgtgaaggtaccgcaatgcagaatttgcaccactatcaaccacggcaacgccgtagttgctcccataatgccccagcgcactacgccgcaaatcgccgagatcaacagcatatcgcgtgcactacaacggcggaaaagtttattactcagcgcaaagataatgacttccgccaccacgcccagcgaccacaaataccccaccgccgaggccgagtagccagctgcctgccagtaaatggcgctaaaaccgtaataggccgcatgtgccccctgcaataaacaaacgcaggccagaaagcgccagttctggcgaaccaacgccaaccacgcagaccagccggtgctctcctgctggcggcttgccccttgtggctgaatcgtcggacggatgagaaagccgagcagcatggatgccacgcccaacgtcaacagcgcgaggatcacccgataatcaaacatactgaccagtttgcccgtcagcgccgagccaatgacaaacgccaccgagccccacagtctcactttgccgtaatcaagcgggaactgcttttgccacgtattcgccagtgcatcggtcaacggtaccagcggtgagaaaaagaggttaaagccaatcatcaccagcatcagccacgctacgtgcgcccccgcccagaaggcgacagcaaagagaagtgtcagcagtgccagcacgcgcaaggcggaaatcaggcgggaaggatcgctgacgcggggcgcgatgagcaaactcccgaggaaacgggcaaccagacccgcccccaataacaggccgatggtttctggcgttaaaccaatccctttaagccagacgctccagaaaggtagaaaaatgccgtaactaaaaaagtatgtgaaatagccgagcgccaaccagcgcgtggattgcaaaaccatgagtccctcccgtcaggaggcgttagtctgaggttaatcgaatgttggtgcaagttgaaaaataagaatattcgagcctgcttcctgacggttatcctgcatatcaggaaatgacaaaaaagagcggcccacaacacaacatgtaaaaaagaacgatgaaacaagtgaaaatcgcaatttattgaactgacaaactcatgtgagacggataaggcgtgcatgtcgcatccggcaggaaacaataagcacattgtcagccatctgcgttatgccgttataccagaaacgaatatctcaacgcctgggcgtggcgaggtaccagagtgtgtattacgtttaaatcacatcatcttgcaaagggattggttatgaactcactacgttattttgattttggcactgcccgccccgttttattattaattgcccgtatcgccgtggtcttaattttcattatttttggttttcccaaaatgatgggctttggcggtacggtccaatatatggcctcgctgggcgcaccaatgccgatgctggcagcgattattgcggtagttatggaagtgcccgccgcgatattaatcgtgcttggctttttcacccgtccgctggcggtgctgtttattttctacacgctgggtacggcggtgattggccaccattactgggatatgaccggcgatgcggttgggccaaatatgattaatttctggaagaatgtcagtatcgctggcgcattcctgctgttggcaattaccgggccgggggcgatttctctcgatcggcgttaggaaagatgccggatgcggcgtaaacgccttatccggcctaccgctccaacaccgattgtaggcctgataagacgcagcaagcgtcgcatcaggcatcgtgcaccgagtgctacaaaatcgaaattaccccgtaggcctgtgcatccggcattttataaattacagcaacgcaacccgcaacgacatctctgaaattgttgattcccctggtgcaagcgcaatgaggtcaccaccttccggacgatgatggtcatccggcgcatggctcatcggttccagacagaagaaatcaaacgcatatcctttatcaaacgccgggtcggaaacaaagatgaaataacacggtgcaggcggcgtcgtttccatgatgatggcataaccctcctgcggctgctcgatgcgggcctgaccattccatccggcaaaaccattgtttacccactggcgcggtaacggcgcgagctggttaaaatccagttcctgcggtagctgctcgcaaaactcacccgccagccactgctcctgctcccgccagtaacagctcgcctgcgcctgaatccgcgtttgtggtgacaacggaaaataaggatgccagccggtaccaaatggcagcgtctctgcccctttattggtgacagagagcgtcaccgtcagcgtatctgccgttaaatgaaacgcctgacttacccgatagtgataaacaccgctgcgatgttcatacaccagacacaagctatcttcgctgcgcgagacacattgccactgccccagccaggcatcaccgtgtagatagtgcgcatcccactcaacattcggttgtagttgatattcacgtccctgccagacaaaacgattaccgctcacccggtttgcaaacggcaccagcggaaaacaagaggcatcggttgccacaccgctttttttaccaggacgtagcagcggcgtcgtatcgcgccagaagccttcgattacgccgccctgatcagaaacgtccagctttagcggcccgtgagataaggtatagatggtcatccgcagactccttaatccgggaaattaatcacaactttcccgcatttgccgcttgccatcagtgcataagcatctcccgcctgttccagcgagaagcggtgggtaatggcattacgcggccacagtttccagtccgttaaatcgtgggcgcatttttccatatggaacagactggtcacccaggagccgataatccgccgttgatggtgcatcaggtcagcgctaacctcgaactcgacttttccggtttcaccaatgtaaaccacgcgtccccagtcagcggtggattgcagtgccagtaagcgacctgcggcattaccggaacaatcaagcgcaacatccgcgccgccgtgagtgagttcggcgattatctgcggcagaccttcggtggtcgctaaatagccgtgatccatcactcctaactgtttcgccatcgccagacgttccggcaacatatcaacgccgatgatcctttttgcaccgcgacctttcgccagcatcatcgccatcatgccgaccggccccagaccgaccaccagtacattatcactgccggaaacttcgccgcgcaaaatcccttcatacgctgtaccaacgccgcaactgataaacgcaccatcttcgtaactcagtgcatccggcaggaggatcagatctttttcttccgccagcaggtattcagcatggccgccgtcacgctgccagccgtaagcggcttttccttcaccggtgcaggagataggaaaaccgcgacggcagttcgggcaaaagccacaaccggaaatgtgatacaccagcacgcggtcgccctctttaaaatggcgacagccttgccccatcgccacaatctgcccgcacggttcatgaccgttgataaatccctggtataacggtttatcgggtgccgccgccgtagcgcggtgctggtggtagatatagtggacatcgcttccgcaaatcccagaggatttcattttgatcagtacctggttaatccccggcgtcggcaccgcaacttcccgcagatcgacggtcgaatttcctggtaaataagctgccagcatcgttttcataaatccctcattaacaatacgattaattttcatccctgccgcacctgcgccaggggcgttaaggtttagcgtttcgctttactgctacgctgggtcagcaagatattcgccagcaccgccaccacgatgatgacgccgcgcaccacctgctggaaaaaggagttaatcccgagcagcaccagaccgttaccgattagcgtaatcaccagtacgccaagcagcgtaccgaacaacgagccgcgaccgccggaaagcgccgtaccgccgacaacgaccgcggcgatgacgtcaaactccagaccgtttgcggcacctgcgttaccggaaccgaggcgcgccgccaacaaaatgccggtcaccgccgctaataatcccgaaagggtaaaaataagaatgcgtacccgacgaacgttaataccgcacaactgcgctgcagtggcattaccgccaacagcaaaaaccgagcgcccgaaggcggttttgcggctaatgaacacaaacagcgcaaataacaccatcatgatcagcgcggataccggcaccccgagaaattgtccgcccagccagtccagcacttcgttttcgttaattggcactggcaaggcgttcgtcataaacagccccattccgcgcagggcgctccataaacccagcgtggcaacaaaacttggcacgttaaacacgccgcgcagcaccccggcgagcgttcccatcagcgcacctaacagcaacaccagcagacaagcaatcgccagcggaacgtcaaattgcagcaaaaacgccaggcacactgaaacaaaagccaccatcggcccaacgctgacatcaatttcaccggagataataatcagcgtcatcgcccaggcggcgatcccaatggtggcggcatcgcgcagcacgttcatctggttattcaatgagataaagccaggcgcattcagggagaagaccagataaagaatggcaatcaccaccagcaaaccgatctcattaatatggcgactgacaaattgtttgagcgagacgctcttgccctgcggcaatggtaatgacgaagcagacatcttcaggttcctcggtaaaattcatcagtgcacagacagaatggcggacatcagctcatccacattgaccggagagtgaaactcctgcgagaacgtaccgtgctgtaacaacagaatgcggtcgcacaccaacggtaactcctccacttcactggagataaacaccacgctttttccttcggcagccagctcgcggacaatacggtaaatctgctgtttggcttcgatatcgacgccgcgcgttggctcgtcgagcaacaaaatctggctggcggcatagacccaacgaccgatcaccactttttgctgattgccgccagaaagcgtgccgatgggcgtttcgctactggcggccttgaccgtcatccgctgcatcacctcttcggtcaggcggcggatggtggaccattgcagcacaccgttggcgctgattttttgccgattggtcagcactgtattttcgtcaacgcccaaccagggaatgatccccgcttctttgcggttttctggcgtatagccaatgccgcgtttcagcatgtcgccgtaatcggggcgcgtgattttctcgccgttgataacaatttcgccctgttcatacgtctccagcccaacaatcgccttcagcaattcactgcgccctgcccccagcagaccagcaatgccgagcacttcgccacaacgtagcgtaaaactgatatcctccagcttgggcttatggcgtaacgcacggacttccagcacggcttgatccataatttcctgaggggcaaccggcgcaatatcaacgtgatcgcgcccgagcattagcgacacaatatgatgcgtagaggtgttttcgagcatcacatcgcccgccacctgaccatcgcgcataacggtggcacaggaggcaatgcggcgaatttcttccatccggtggctgacataaatcaccgccacgcccagtgccgacatctttttcaccgcgctgatcaccagttcaacttccgcactggcaagcgagctggtgggttcatcaagaatgaccacgcgcggctcgcccttcatcacccgcgcaatttccaccagttgcttttgcgccgggcttagtgttgaaacaagttgttcaggactaacgtcaacgcccaacgcctgcaagcaacgttgggcgtcctgcgccatttgcaggtaatcaatcatgccgttgcggcggggccactgaccgaggcagaggttttccgccactgtcagcccttccaccagacttaactcctgataaaccgcacgaacccccagttcagcggcacggcgagtcagcgtagcttcgtcaccttccagtcgcgtctcgccaatccagatatcaccgctatccggacgttcgctaccggtcagcattcgaatgagggtcgattttcccgcaccgtttttgcctaacagcgcgcgaacttcgcctttattgagcgtgaagttaacgttatccagcgcaacgacgccggggtaacgcttatttcctgccaccacttttgctaccgggactgcctctgttgccgtgaacatagggacctctgcgaatcagcgattagggcagaccatcaacgtgcgttgccagccactgtttaccgtcttccgttttggtatagagatcgattggcacctgaatcactttttcaccgtcggcttgtttattgataaccttcaatgtttgcgcgaaaacagcattgcccattttcttaccggaaatatccaccaccgctttcagcacctggttgttttccagctcctgagcaatttcagtggtcatatcagaaccgaaaacagcaatttttccggcctgattttgattacgtaccgcttttaccgcgccgagtgtcgctccgcccgattcccccataatggcgttgagatccggcgtggagataatcagtttttcaccgacagaaatcgctttatctaaaacagtcccttcctgattagcgacaatttgcgcgccgggaacgcgggtttttaatacttcttcaaaccctttacgacgttgcacacaaacttcaaaggcttcgcaattgatgacggcaattttcggctggtcaattttgttggcaataaaataatcggcggctgcgttacccagttttttaccaaattccagcgggtcaccaaccagatatgccgagacatatttatcgacacccttttgattaatacaggtgttgtagcaaatcaccggaatacccgcttcactggcgcgacgaacggtacggctactgccattttcagacactgccgataaaataatggcatcgacattacgcgccacgagggtatcaacaaaggtactttctttcgaaatatcgccctgagcgttagtttcaattaattgtacctgtactgaagaatcttttgccgcatcctgaacgccctgacgcactccggcgtaatatccctgggtatcaaggtatattgcgccaatagtcatttctttatcagaagccctggcaaatagtgcgctacccaatagcgtagccattaataataaattacgggttcttgtcatttttttaggcatagtacctcctgtagggtttttatttacaacggcttattttaattatttgagcgtgagcggcagcgcgtgccgctcaaatattacagttaatagggtttagtgaacgtagctaaaaataaaaggcatcacggtggtgaataatgccgctttcggccaggctggattaatcgccatcaattcagcgcgagcagattcatagtgcgcaacctcccctaatcccgcggccgccagcatcgccaccatcaggcatttttctttatgctgctgttgtaaatcgctatacagcgacaacaagtcaggctgcgagacggcaaagaaatccgcttcgatactggttttcgccatctctttcgcccactgtttcatttcactaaacagttgctgtgcggtgtgttgttcgcccagcagtcgcagcgccattccttgccagaagagataatcaaccggctgatcgttgtaataactgtggatgttaatggtgcgatcgccggtcgccgccagacgtaaacaacgcgtcgcttcagtttcatcgccctgcgcgttggcgcatactgcctgccagaaccagatgtcgttgtcagtttgccccggtaaacggccttcgcttaaattctccggataatgcagcgcggcatgaagcagttcgctggcctgctgcggctgtctggcatcaagatgctgccaggcgcgtaataactggttgaggataaactggctggtgaccttcccttccccaccttcccacgggtggaatttgcgcgtggcgagaatgtccgccgctttgtctgcctgaccagtgagatgccacaaattgagcagttctgcggtcatgtcgtcgcgtttcagcgcaatttccagattattttccagacgcgccagtcgtttctccggtgtgacaccgcttaacttatccagcaaatcccgttcgaaaagcagacgtgcatcctgcggcgcaagctgataagcattatcaagataacgcgcggccagctcataatcgtgctgcttattccacgcatggatcgccaacccgcgccagccgtcggcaaactccggcgacatctctacgcaacgctgccataaggcaatggctttgccgtagctacgcttgttgtagtagaagcaggccagtaaatgccgggcaaaccagcactcttcgatactctccagcgccgccacttcttccagcgtattcgggaaacggacaaactgcgggaaggcatcaatagcttttgcgaccagttctccgcgttcagcttttggtagcaaactggcttgcaggtaaagcggtagcgtgcgctgacagtccagtgcgttcagcatctctgccgccagggcgggcatgccccagttaatcagttgcccggcggtcatcagggcgttaacgtcgcgtccctgacaaagacctcgccactgcgcgagggctgattcgctacgaccatcgaaccagttcagccaccacagagtggcgttcagcggataatcacgcagcagtttctcgcgctgcaaacgcgcgttgtcctgacgaccacttaacaccagtagcaggttatgcaggcaaagcacttcctgattggttgggcaggcgcgaagactttgttggcaaaaatccagaccagtgtcgaagttaccattacgcgccgccagtcgtgccagaccataatagccaccggctttactgttgccgctccagaccgcacgccagaaatcctcttcggcttgttgatattgcccctgacgttcgtaagcactggcgcgaatcaaactcgcctgtccgcactgcggatttttgttcagcgcatgtgcgcgtttcagcgcctgagtggcatacgccaccgcttgcgggaaatcggcgcggttatattccagcattgccagcgccaggttacagcgataatccagcggatccagcgccacgccgcgcagatagtaatcgaacggtgaacggctcgcgtgatgatattgctccagatgttgaccgataaaccaggcttcatctgtactggtaatgtcttgtgctgccagtggcgctttggcgacgtccggcaacggcaacgcttgcggctgatgttcatcataactcagtacaatattgccgtcggcatcggagagctcaatggtcagcctttcaggattgataccgtgcaacacgccctggatggcggtcgctggtgtcagggccacggcatcatcgagcaacgcgttgcatttgccgatttcgcggatcgccaggcggtatccgttcaacggagagatggcatacagcccccactcaatcccccgctcactacgctggagttttatcaccgcatcgcgggaggcattttgcaccatgcccagagaatgataaggcaggaaatactgctcgaaacgcttctcctcgtatgcatcaagccaggtaaaatcaggctggttatcggcaaaaataccggtcatcagttcgatatacgggccgttattgtcagtcaggctcttatcccacgcctggccaaattcactgtgtccccaactccactgttttttacctggcgcaatatggtggttggcaacgtgcagcaaaccgccatcttcatcgtgacaccacgcgccaacaaaatcgtactgtgatttttcagccatatatgaggttggaacgggcacatttttatagcgagaaatgtccactccggcggagtagtccactttgtagtaagtgccggtggcgatggggaaagcggagacggcccgtttgccgtgatcaaacaccgcagtcacatccggtgggaaaacgctctgatgcccttcaccccctttcactgccgggttggcccaccacaagaaatgacgcggcgtggcgttgccgttatagacgcgactggcgatttccagcgccgcccggtcagggcgcagggtgaaacctgtcatcacctgtaaaccgtgcatcggctccgtttcgccgacccacaccgtctgtgcgccgtcgtcatgggcgtcgagggtgaaatcaacgggcataaaggtggtcgggcgatggtgttgcggccagttaaactcaatcccgccggagatccacggccccagcagtcccaccagcgccggtttaatgacttcattgtgataaacaaaatcgcgctgtttcactttatcccacgcgcgatgcacccgaccgcccagttccggcaggatcatcactttgatgtagtcgttttccagccacaccgcctgccaggatttcagggttttctgctcgctcagcgtatcggtcacgccgtagggataaaccgcgccggacgatccctgataaacgcgattttccaggaacatgggatgtatatcctgcggcccggtttcataggtcgggatctcaacgcgctcttgccacacttttactggagtcatggtgccctcaatattaacaagacatactgaattaaaagatttgtggcagtgtattgaacaatctggcactgttttcgcggaataatcacgcaattaactaaacagggtttagtgaagatgagagcctgcattaacaatcaacagattcgccaccataacaaatgcgtgattctggaactgctgtaccggcaaaagcgcgccaataaatcaacgctggcccggctggcgcaaatttcgattccggcggtcagtaatattttgcaggaactggaaagcgaaaaacgggtggtgaatatcgacgatgaaagtcagacgcgcggacatagtagcggtacatggctgattgcgccggaaggtgactggacgctgtgtctgaacgtgacgcccaccagcattgagtgtcaggtcgctaatgcctgtttaagtccgaaaggcgaatttgaacgctttcagattgacgctccaacgccgcaggcgctgctgtccgaaatcgaaaaatgctggcatcgccaccgtaaattgtggccggaccgcaccatcaatctggctctggcaatccacggtcaggtggatccggtgaccggtgtgtcgcaaaccatgccgcaagcgccgtgggcaacaccggttgaggtgaagtatctgctggaagagaagctgggcattcgggtaatggtcgataatgactgcgtgatgctagcgctggcggagaaatggcaaaataattcgcaagtgcgtgatttctgcgtaatcaacgttgattacggcattggctcgtcgttcgtgattaacgagcaaatttatcgcggcagtttgtatggcagtggacagattggtcacaccatcgttaatccggatggcgtcgtctgcgactgcgggcgttatggctgcctggaaaccgtcgcctcgttaagcgcattaaaaaaacaggcgcgggtatggctaaaatcacaaccggttaatactcagcttgatcctgaaaaattgactaccgcgcagttaatcgctgcctggcagagtggagaaccgtggatcaccagttgggttgaccacagtgccaacgccattggtttgagtctgtataacttcctcaacatcctcaatattaatcagatttggttgtacggtcgcagttgtgcctttggtgagaactggcttaataccattattcgccagacgggatttaacccgttcgaccgcgacgaaggaccgagcgtgaaagcgacgcaaattggctttgggcaattaagccgcgcacagcaggtgctgggaattggctatttgtatgttgaggcgcagttacggcagatttgatggcgcaataacgtagaaaggcttcccgaaggaagccttttttcaacagattaaccgtttcgcttacgcgtaaaccgggtaacgtgcgcagatgtcgagaactttacctttgatgcgctcgataacggcttcatcattgatgctgtccagcacgtcacacatccagccagccagttctttcgcttcggcttctttaaagccacgacgggtaatcgccggagtacctacacgaataccggaagtcacaaacgggctcttcggatcgttcggtacgctgtttttgttcacggtgatgttagcacggcccagagcggcgtctgcttctttaccggtcaggtttttatcaaccagatcaaccaggaacaggtggttatcagtaccaccagaaaccactttgtagccgcgttcgaggaacacttctaccatcgctttggcgtttttcgcgacctgctgctggtaagttttgaactcaggttccattgcttctttcagagcaaccgctttaccggcgattacgtgcatcaacggaccgccctgaccaccagggaaaacggcagagttcagttttttgtacagctcttcgctaccacctttcgccaggatcaggccgccgcgcggacccgccagggttttgtgagtggtggtagtaacaacatgagcatgaggaaccgggttcgggtagacgccagcagcaaccaggcccgcaacgtgcgccatatcaacgaacaggtaagcaccgatgctgtcagcgatttcacgcattttcgcccagtcaaccacgccggaatatgcagagaagccaccgataatcattttcggtttgtgttctttggcttgtttttccagatcggcgtagtcgatatgaccggtagcatcgataccgtaaggaacgatgttgtacagtttaccggagaagttaaccggagaaccgtgagtcaggtgaccgccatgcgccagattcatacccagaacggtatcgcctggttccagcaacgcggtgtagaccgcaaagttagcctgggagccggagtgcggctggacgttagcgtagtcagcgccgaacagttctttcgcacgatcgatcgccagttgttcaacgatatcaacatactcgcaaccgccgtagtagcgtttgcccggataaccttcagcatatttgttggtcagctgagaaccctgcgcctgcattacgcgcgggctggtgtagttttcggaggcgatcagttcgatgtgctcttcctgacgtactttttcctgctccatagcctgccacagttcggcatcataatcggcaatgttcatttcacgctttaacatccgcatctcctgactcagctaacaataaaatttttggcctttataggcggtcctgttggacaacggcgaacagtataaccgaatcattgtgcgataacaggtcttgacaaaggaatttacgcaaacgattaccttcaggctacgcaaggctttggagaataaagagcttgcaaccggaaacggatttcttttcaggtttgtgatgcaaatttttcacttcatcacattctttctgaaaaacaccaaagaaccatttacattgcagggctattttttataagatgcatttgagatacatcaattaagatgcaaaaaaaaggaagaccatatgcttgacgctcaaaccatcgctacagtaaaagccaccatccctttactggtggaaacgggaccaaagttaaccgcccatttctacgaccgtatgtttactcataacccagaactcaaagaaatttttaacatgagtaaccagcgtaatggcgatcaacgtgaagccctgtttaacgctattgccgcctacgccagcaatattgaaaacctgcctgcgctgctgccagcggtagaaaaaatcgcgcagaagcacaccagtttccagatcaaaccggaacagtacaacatcgtcggtgaacacctgttggcaacgctggacgaaatgttcagcccggggcaggaagtgctggacgcgtggggtaaagcctatggcgtcctggctaatgtatttatcaatcgcgaggcggaaatctataacgaaaacgccagcaaagccggtggttgggaaggtactcgcgatttccgcattgtggctaaaacaccacgcagcgcacttatcaccagcttcgaactggagccggtcgacggtggcgcagtggcagaataccgtccggggcaatatctcggcgtctggctgaagccggaaggtttcccgcatcaggaaattcgtcagtactctttgactcgcaaaccggatggcaaaggctatcgtattgcggtgaaacgcgaagagggtgggcaggtatccaactggctgcacaatcacgccaatgttggcgatgtcgtgaaactggtcgctccggcaggtgatttctttatggctgtcgcagatgacacaccagtgacgttaatctctgccggtgtcggtcaaacgccaatgctggcaatgctcgacacgctggcaaaagcaggccacacagcacaagtgaactggttccatgcggcagaaaatggcgatgttcacgcctttgccgatgaagttaaggaactgggtcaatcactgccacgctttaccgcacacacctggtatcgtcagccgaatgaagccgatcgcgctaaaggtcggtttgatagcgaaggtctgatggatttgagcaaactggaaggtgcgttcagcgatccgacaatgcagttctatctctgcggcccggttggcttcatgcagtttgccgcgaaacagttagtggatctgggcgtgaaacaggaaaacattcattacgaatgctttggcccgcataaggtgctgtgatttgatgttgccggatggaaacatccggcaacccttgacccgttttaaatcgccgcatcatcctcttcaccggtacggatacgaatgacccgtgccacgtcgaagacgaagattttaccgtcaccgattttgccggtttgcgccgtgcaaataatggtatcgacacaggtatcgacaatgtcgtccggtacgacaatctcaattttcactttcggcagaaaatccaccatatactccgcaccgcggtacagctcggtatggcctttctggcggccaaaacctttcacctcagtgaccgtcatgccggtaataccgacttcagccagtgcttcgcggacatcgtccagcttgaagggtttaataatcgcatcaatctttttcatgctattccttgaaaaggtcgcctgtcttttgatctgctaaacgtaacacataacgccaattcattccttgaaatcgtttgcatccagttcgtgtcgggaaagcagtttataaaattctgtccggttgcgccccgccattctcgccgcgtgggtgacgttgcctttggtgatttgcagcagcttacgcaaatagttgagttcaaactgattacgcgcctcaacaaaggttggcagcgccgtgttttcgccctccagcgcctgctccaccagcgcatcactaattaccggagatgatgtcagcgccacgcactgttcaatcacgttgaccaactggcgcacgttgcccggccagctcgcagtcatcaggcgtttcattgcatcggtggagaacgcgcggacaaacggtttatgtcgctctgccgcctggcgcaacaggtgatttgccagtagcggaatgtcttctgtgcgctccgccagtgccggaattttcaggctgacaacgttgaggcggtaatagaggtcttcacggaattccccgcgcgtcatcgcttttggcaggtcgcggtgggtcgcagaaataatccgcacgtcgatatcaatatcgcggttactgcccagcgggcgcactttacgctcctgcaacacgcgcagcagtttgacctgcaacggtgcgggcatatcgccaatctcatcgagaaatagcgtaccgccttccgccgcctggaataaaccttcgcgattgctgacagcgccagtaaacgcgccacgtgcatgaccaaacagctccgactccagcaattgctcgggtaatgcgccacagttaatagcaataaatggcttgctgttgcgcgggctggcgttgtggatagcctgggcgaaaatctctttcccggtgccgctctggccgttaatcaaaacgctaacgtctgattgtgccaccagccgcgcctgttccagcaagcgcagcatcagcgggctgcgggtgacaatcgcctcgcgccaacgttcgtcggtggctggcgcggattgttccagcgcatcgtcaattgcctgatatagcgcatctttatcgacaggcttgatgagaaaactgaacacgccctgctgtgttgcagcaacggcatcaggaatagaaccatgcgcggtaagaataattactggcattcccggctgcactttctggatttcagcaaacagctgcataccgtccatttcatccatccgcaggtcgctgatgactaaatctactttttcgcgattcagtacccgcaatccttcagcaccactttccgccgtgaccacactgtagccttcgctggtcaggcgcaggccaagcagtttcagcaatcccggatcgtcatcgaccagtaataaatgcgcaggtttatggctcatcaggagtgacctcatcggtggatggcgcgggcttttcactctcgtgcggcgtatccggcgagaaatttccggccggtttgcgggtcgagagctggcgttcaatatcggtcaggttttccagcttgcgggtagtgagttccagttgctgttgtagaacgtgatgttgctggcgcaaagtatccagctcgctgtcgctggactgctggagtttgctgtagcgttggcgctcttccgccagttgcagttgcagcgcctgaccgtcgcgccaaagttgatacagtgggcgaacctgtgccgggatctcggtacttagcgcatcaatgcgcgcgaccagctggcggcgctcatacggagtaattttggcgtcggcgagcaaaatcccttgtttaaaggtattttgccagttgccgtcgtcatattggcgggcttgctgacgcgactgcgcaggcattaaacgatcagcacaatccatcgcccgcagccagtaaagcggattggtttcggtagatttaccttgcagcgcccagatgtcgctacattcagtagaaagatagtcagccagttgataaaccggaattttttcttctgctggcgtatcaatggctggcctattgtgactctgcacgcaacccagcaatgccagacatggcagccctgccagccacagccgtcggggcaataatcgttgaaaaatgtgtcgcatattcaccagacttaaagcctatcccagtgggcgtaattgttgcaggcagtttggacatggacagcgcggagaaaccggagcgtacatgtcgtacgtgaagatttcgagcactgcccggggccgaactgacaaataaaatagcctgatgggatgggctgttagcattatttcgtgtttttcgacgacggtaattcaatgcggaaacaaacgtcttgcccgctctcgtcgaccagatacagttccccttgcatacggcgaatacaatccctggcaatgcttaatcccagaccgctgcccttcaccgccccttttcgctggtggcttccctgaaaaaagggttcgaagatcatggcgcgttcctcttgcggaatgggcgtgcctgtattgatgacatcaatataaacccgcgcaccatgtaaactgctacgaaggcaaatgttaccggattcagccccgtagtgcaccgcattggagtaaagattatccagtacgctcatcagcagcattggctccgccaggcaagctgttgctttgagatcaacgtcggtatgcatcattttagcccgtgcgggcaggctatgagcagaaaccactgtctccaccagcggtgctaactcaacattctccagttccaccgcactgtccgcctgtttacggttgtaatcaagcagttgttcgatcagcttttgcaaattgcggctgctgctatcaagaatgctcaccacctctttttgctctggcgtaagcggcccgacaacctgatcagccagtaattcagtgccctcgcgcatactcgccagtggcgtttttaattcatgagataaatgtcttaaaaattgatggcgttgggattccagccatgacaggcgctcacttaaccaaagaatacgttgcccaaccgagcgtaactcgctcggtccactgaacgagacgctattgcccagagaacgcccttcccccagccggttgatcatgcgctcgatatttttcaccggaccgataatcatcctcgtgaaaagcagtaccatcaccagactcaccagaaatagcaccagcgattgccaaccaaaatattgcccacgttcggcgatttcacgctgaagttgctgcccacgagagaacaccactgtgcgcgtggcctgcaccatttcggtattggcactggcaaaggcttccagacgcgcggcggcagcagcatcgggaccgctgttgttacactgaagttgagccagattgttcaaatcctgacgtaatgcctggtagagtttatcgtccggcagcacgcctgcgtgggcatcgagcatttcgctgtaacgcttgcgctggctttgataaaccttcgcaagcgtagggtcgtccagcacgcagtactgacgatagctgcgctccatctccagtgccgcgttggtcatcgcttcactgcgccgggcatcaataagcgtagtgcggttaaccagcgccgcctgatcgctaagtgcattcaggctttgccaggcttgccatgccagcaccaacaggggcagcagaatcagcaaaaatgccagcattaccagttgtcgtaatgagcggggaaaaacgggccagcgtttcaaggcgttactctcgtcagacgcgaatagcctgatgctaaccgaggggaagttcagatacaacaaagccgggaattacccggctttgttatggaataaggcggtgcctaactcgacgtttcgcccgatggttgatatagctacgctgatatcagaagttggacggcaggcaccttgttgtgcgtcattcgaattttatgtagcacgtcccgaaggggctgacataagtcggcgaatgagccactgcttactattatgcagtaactgtgccaacaaagaaaatagtttggtaacatactgattatacgctgctttgaggggtttatggcttctccgctatttgaatgtaaatcagccactgtgtcgctaaaaagagacaacttaagataaacttattagataatattaaaatcaatgagttaagtgtcaccaaaaagcgacacggcaaaccacccattgtcgtgatttacagacacaaaaaagctcccgaagttgggagctcataatagcggttggtgcttaatgccggatgcggcgtgaatgcctcatccgggctgcaataccaatgggttgacgacttaccccaactgcttacgtgcattgcggaaaatgcgcatccatgggccatcctcgccccagttttccggatgccaggagttgctgacagtacggaaaactcgttccgggtgcggcatcataatggtgactcgaccactttcagtcgtgaccgccgtaataccgttcggtgaaccgttcgggttagccgggtaggtttcagtgactttgccgaagttatcgacatagcgcagtgccaccagccctttgctttccagtgccgccagatgcgccgcatcgcgcacttcaacgcgcccttcaccgtgagagacagcaatcggcatctgcgagcccaccatcccctgcaacagcagcgacgggctttgggttacttctaccagactgaaacgcgcttcaaagcgatcggaggtgttacgcacaaaacgtggccacaactcgctacctgggatcagttcacgcagattagacatcatctggcaaccgttacatacccccagcgccagcgtttgcggacgatggaagaaggttgcaaactcatcgcgtacacggtcattgaacaggatagacttcgcccaaccttcaccagcgcccagcacatcaccgtaggaaaaaccaccgcacgcgaccagggcgtggaaaccctccaggcccgtgcgtccagccagcagatcgctcatatgcacgtcgatagcatcgaagcctgcacggtggaaagctgccgccatttcaacatgggagttcacgccctgctcacgcagcacagcaactttcggacgcgcgccagtggcaataaacggtgctgccacatcttcgttgatatcgaacgacagtttcacattaaggcccggatcggcgtcgtttgatttcgcctgatgttcctgatcggcacactccgggttgtcacgcaggcgctgcatctgccaggtagtttctgcccaccagacacgcaacgtggtgcggctttcgctaaatacagtctgcccgttggcggtaatcacaaaacggtcaccggaaaccgcctgcccaacataatggacgcaatcagcaagcccatgctgtgccagtaccgcttcaacggcttcacggtcagcggctcgcacctgaatcaccgcacccagttcttcgctaaacaatgcagccagacgatcgtcacccagagtggcgatatctgcgtcaatgccacaatgaccagcaaacgccatttccgccagcgtcaccagcaggccaccgtcagagcggtcgtgatacgccagcagcttacgctgtgcaaccagcgcctgaatcgcgtcatagaagcctttcagttgggcaacatcgcgtacatctgccggtttgtcgccaagctgacgataaacctgcgccagtgccgttgcgcccagcgcgttattgcctttgcccaaatcaatcagcaacagtgcgttatcttcggtagaaagctgcggcgtaatggtgtgacgtacatcttccacgcgggcaaatgcggaaatcaccagcgacaacggcgacgtcatttcgcgctcttcgttaccttcctgccagcgggttttcatcgacatagagtctttacccaccggtatcgtcaggcccagcgccggacaaagttcttcgcccacagctttaacggcttcatacaggcccgcatcttcaccagggtggcctgccgccgccatccagttggcggaaagtttaatgcgtttgatatcgccaatttgtgttgcggcgatgttggttagcgcttcaccgactgccagacgggcagaagcggcgaaatccagcagcgcaactggcgcacgttcgccaattgccatcgcttcgccatagtagctgtcgaggctggcggtagtgaccgcgcagttagcgaccggcacctgccacggccccaccatctgatcgcgcgccaccatgccggttacgctgcggtcaccgatggtcaccaagaaagttttctccgccacggtcggcagatgcagcacgcgtttcaccgcgtcagcgatggtgatcccttcacgggccagcgcgtcgcctttcgctttcagcgtttgtacatcgcgggtcatcttcggcgttttgccaagcagtacgtccagcggtagatcaatcggctgattatcaaaatgacgatcgtgcaaagaaagatgcagttcttcggtcgcttcaccaatcaccgcgtatggcgcgcgctcacgcttacacagttcgtcaaacagcggtaactgatcggcagcaaccgccagcacgtagcgttcctgggattcgttacaccagatttccagcgggctcatgcccggttcgtcgctcaggatatcgcgcagttcaaatttaccgccgcgcccgccgtcgctcaccagttccggcatggcgttagaaagaccgcctgcgccaacgtcgtggataaacaggattgggttggcatcaccaagctgccagcaacggtcgatcacttcctggcagcgacgctccatctccgggttgtcgcgctgtacggaagcaaagtcgaggtcggcatcagactgaccagatgccatggaagacgccgcgccgccgccaagaccgatgttcattgccgggccgccgagaacgaccagcttcgcaccaacgttgatctcgcctttttgtacgtgatcggcgcgaatgttgccgatcccacccgccagcatgatcggtttgtgataaccgcgcagctcttcgccattgtggctgttcactttttcttcataagtacggaagtagccgttcagtgccggacgaccaaattcgttgttaaacgccgcaccgcccagcgggccttcggtcatgatgtccagcgcggtaacaatgcgctcaggtttaccgaaatcttcttcccacggctgttcgaagccaggaattcgcaggttggatacggagaaaccaaccagaccagctttcggctttgcgccacgtccggtggcaccttcatcgcggatttcaccgccggaaccggtcgccgcgcccggccacggagaaatcgccgtcgggtggttgtgagtttcgactttcatcagaatatgcgccggttcctgatggaaatcgtagcggcccgtttcgtggtcagcaaagtagcggcccacttcagaaccttccattacggcggcgttatctttataagcagagagaacgtgatccggcgtggtttcgaaggtgtttttgatcatcttaaatagcgatttcggctgctgttcaccatcgataacccagtcggcgttaaaaattttgtggcggcagtgctcggagttcgcctgggcaaacatatacagttcgatgtcgttcgggttacgaccaagctttgtgaaagcatcctgcaaatagtcaatttcatcttccgccagtgccaggccaagacgcaggttagcgtcgattagcgcctgacggccctgcaccagcaaatcaacgctggtgaccggagtcggttgatggtgtgcaaacagctgctctgcatcatctaaagcaaaaaagaccgtttccatcatgcggtcgtgcagttcagcggtaacctgctgccattgttcattggtcagcgtaccggcttctatatagtaagcaacgccgcgctcaaggcggtttacctgttgcagcccgcagttatgggcaatatcggtcgctttcgaagaccagggagagatggtgccaggacgcggggtcaccagcaggagtttgccttgcggggcgtggctggcgagtgccgggccatatttcagcaggcgttcaagttgtgcgtgctcatcatcgtttaacggcgcattgaggtcagcaaaatggacatactcggcgtaaatagtgtgaaccgggagcctggcagcctgaaaacgtgccagcagtttgttgattcggaatgccgacaatgcaggcgaaccacgcagaatttccatcataagtctctcgtcttctaagctttcggtgtacccaagggggggaaacgggcgtcattataaagaatctgatgcgctgacgaaaccgtttgcgtggaaataaaatcaccatcgtgaattagcaacgcgtgccgccaatggctgtaataagttgccatctggcgcaggtttacgcaaaatgccgctcatttatgagtaaacctttcactattattacgttttttcaagctgggacgcgcacgacacagagaattaactaattgaaaaaattaaagattaattatctgttcatcggcattctggcactgctgctcgcggtcgctctctggccatccattccctggtttggtaaagccgacaaccgtatcgccgccattcaagcgcggggagagttgcgtgtgagcaccattcatactcccctgacttataacgaaatcaacgggaaaccttttggcctggattacgaactggcgaaacagtttgccgattacctcggtgtaaaactgaaagtgaccgtgcggcagaatatcagccagctgtttgacgacctcgataatggtaacgccgacctgctggcggcaggactggtctataacagtgagcgggtaaaaaattatcagcctggtcctacctattattccgtgtcacaacaactggtttataaagtcggtcagtatcgcccacgtacgctgggcaacctgacggcggagcaactcaccgttgcaccgggtcacgtggtggttaacgatctccagaccctgaaagacacaaaattcccggaattaagctggaaggtagacgacaaaaaaggctctgcggaattaatggaagatgtcatcgaaggaaaactcgattacaccattgctgattctgtcgccatcagcctgtttcagcgcgttcacccggaactcgccgtagcgctcgatatcaccgatgaacaaccggtgacctggtttagcccgttagatggcgataataccctttccgccgccctgctcgacttcttcaacgaaatgaatgaagacggtacactggcacgcattgaagagaaatacctggggcatggcgatgattttgattacgtcgatacgcgcacatttttacgcgccgtcgatgcggtactgccgcagttaaagcccctgtttgagaaatacgccgaagaaattgactggcgtttgctggccgctattgcttatcaggaatcgcactgggatgctcaggccacttcaccgacgggtgtgcgcggcatgatgatgttaaccaaaaacaccgcgcaaagcctcggcattacggatcgtaccgatgccgaacagagcatcagcggcggcgtgcgttatttgcaggatatgatgagtaaagtgccggaaagtgtgccggagaacgaacggatctggtttgccctcgccgcgtacaatatgggctatgcgcatatgctggatgcccgcgccctgacggcaaaaaccaaaggtaatcctgacagttgggctgacgtaaaacagcgtctgcctttacttagccagaaaccctattacagcaagctgacttacggctacgctcgtgggcatgaagcctacgcttatgtcgaaaatattcgtaaatatcagattagcctggtgggttatctgcaggagaaagagaagcaggctacagaagcggcgatgcaactggcgcaggattatccggcggtatcgcctacgaagctgggcaaagagaaatttccttttctctcgtttctttcccagtcgtcatcaaactatttgacccacactccctctctgctgttttccagaaaagggagtgaagagaaacaaaattaatctgtcgaggattgggcttttttctgcgctttaatttcctggcggcgcatgcgaaagaagtcactgagcaacgccgcgcactcatccgccagtattccttccgtaatttccacccggtgattcatacccggatgatgtagcacatccattaaagatcccgcagcgccagttttcgcgtcacgcgcaccaaagaccacgcgaccaatgcgactgtggatcatcgctccggcacacattacacagggttcaagcgtgacatacaacgtggcgtcgatcagacgataattttgcatcaccagaccgccctgccgcagagccatgatttctgcatgtgcggtgggatcatgtcgaccaatcggacggttccagccttcgccaataacacgattgttatgcactaataccgcgccgaccggtacttcccgctcatcccaggcacgcttcgccagcgtcattgcatgacgcatccagtattcgtggctaaattcgacttcagacaaaaagaaaactccggttataaaagcgcggcgcattatacacggacgctatgctttactctattccagttgctggagttcaccgcgcggagttactcgccaacgatgctgacagaaataaagcagcgggttgtcctgattactgtcgctatagccactgtacagccgcagcggcgtgccgattttgcgctccagttgcgcgaccttttcatgtcccagacaacgcatcgtcaatacccaaccaccatagccacgctgaatctgactggcgataagattaacccgcggcagccagggcgtatcgaaataaaccgcttcaaccagcggctgcggagagccggtaatcaaccagatatcagcatcggaacttaacaggtaggtggttaatcgctcctgaaccagcggaaaggcggtaacattgtcacgaaaccagcgtacgaaatcggcctgcaacgcctgcaaacgcgcttcattgtgaccaaaagtgcatccccacagaagcagactcatcggccagcgtgccgcacgaccttttatcaataacgcaatggctatgatcggcaacaacggcagaacaagtaacgcattcagcggttggcgacgcagtaaataacgcaaaaaactgccgaacatatcctgctgatgcaatgttccatctaagtcaaaaaacaccacacgacgctcgtgagttgccaaaccatactcctctggactgaaacatcctgattaattttcgctactacatagcctaacagatagatcatcacttttccggcaacaatcgaccgcatcatggctaactggaatttttaattcatggcaattagcggcaatggaatataaaattcactcgcgtgtgtctcatattgcctgttgtcgccattatttcatcgcgaggaaagatatgaacggcttacttcgtatccgtcagcgttaccaggggcttgcccagagtgataaaaaactggcggattatctgctgctacaacctgatacggcgcgccatttaagctctcagcaactggccaacgaagccggagtcagtcagtccagcgtcgtgaagttcgcgcaaaaactcggctataaaggttttccggcactaaagttggcgttgagtgaagcgctggcaagccagccggaatctccctccgtgcccattcataaccaaatccgcggtgatgatccgttacggctggtcggcgaaaaactgattaaagaaaatactgccgctatgtacgcaacgctaaacgttaatactgaagagaaactgcatgaatgcgtaacaatgttgcgctctgcgcggcggataattctgaccggtattggcgcttcgggtctggtggcgcaaaactttgcctggaagctgatgaagattggcttcaatgctgccgcagtgcgcgatatgcatgcgctactcgctacagtacaggcgtcgtcccctgacgatctgttattagccatttcctacaccggtgtacgacgcgagttaaacctggcggcagatgagatgctgcgagtgggcggaaaagtgctggctattaccggctttactcccaatgccctgcaacagcgtgcttctcattgcctgtataccattgccgaagaacaagcgacaaacagtgcttcaatctctgcttgtcacgcgcagggaatgttaacggatttgctgttcattgcgctgattcagcaggatctggaactggcaccagaacgtattcgtcatagcgaagcgctggtgaaaaaactggtctgagtaaagaatgcgcgtataatgcccgcccggtttgtgttgttttgagagtttccttatggcgctgttaatcactaaaaaatgcatcaattgtgatatgtgtgaacccgaatgcccgaatgaggcgatttcgatgggtgaacatatctacgagattaacagcgataagtgtaccgaatgcgtagggcactacgagacaccaacctgccagaaggtgtgtccgatccccaatactattgtgaaagatccgcaacatgtcgagacggaagaacagttgtgggataaatttgtgctgatgcaccacgcggataaaatttaatattctgctctggaagtagagtgttaattattttataggaaaatcttaacgctattatatttatttaaatgatgacattagcataatcattcactaagttaatttatatagtatctgcccagacacttatttatagttattaaaggcgcgtccgactggttcaccggacgcaccttaagtacgtttccttgtgttataagaacaaaaggagcagctgtaaaacagcaatgatgattttgatgacccgtttaatcaggtatcggcaatcagtcattcgtttttccttaaacaaggaatgcagccgttcagattagcccttacatctccccaaaactgaacgtgcgagttattggaatcgagtgctgcactccacaccagagctttgacgacaccactcgtttcaatgggggaattcagtggcatggtgtaaagcacagcaaaattgccaataacgaaaccgattttaatgtacttatcaaaaagcggtcacgttaatcttttcatcaatgtcgatttcttcgtaaaggctcgcgttttttatgtcagagattgcaagttgcttgtacaggtcaacgaaattgatccataatcattttcgttggaatcgtgtgctgcacaaaattaaagttaaaaagtaaaacccccgttccttaccagttcgggggttttactttataaagagaacggtattattttaactttcaataattaccgtggcacaagcatagtggcgctcatcggcaagcgttacatgcatatttacaacgccgagcttttccgccagttttaatgcctcaccccatagccgtagccgtggtttgccgagctcatcattgaatacttcaaactgattaaacgccagaccattgcggatccctgtgccaaatgcttttgccgccgcttctttcacagcaaaacgcttcgccagaaaacgcactggctggtggtgcgttttccagatttcccattcgttatcgcttaatacgcggcgtgccaggcgctcaccggatcgggcgatcaccgcttctatgcgagcgatctctacaatatccgtacctaaacctaatattgccattagccacgcgcttccagcatcagacgtttcatttctgccaccgcatctttcagtccggtcatcactgcacgaccaataatggcatgaccgatattcagttcatgcatctcagggatggcggcaatggctttcacgttgtgataggtcagaccgtgtccggcgttaactttcagaccgagactagtggcaaaggtcgcggctttggcgatacgcgccaactcttgcgcctgttcggcgtcagttttggcatcagcatagcaaccggtgtggatctcgataaacggtgcgccaacctctgccgcagctttgatctgctcttcatcggcgtcgataaacagagaaacctggatcccggcatctgccagacgtttgcaggcatcgcgcattttttcacgctgccctgcgacgtccaggccgccttcggttgttacttcctgacgcttttccggtaccagacagcaaaaatgtggcttcgtctcaacggcgatcgccagcatctcttcggtcaccgccatctccagattcatgcgggtatccagcgtctggcgcaggatgcacacatcgcggtcggtaatgtggcggcgatcttcacgtaaatgcacggtaatgccgtccgctcccgcctgctcagcaataaacgccgcctgcaccggatccgggtaagcagtaccgcgcgcgttacgcagcgttgcaatatggtcaatgttgacgcctaacagtaattcagccatgacaatcctcatcattcataatgtgttttcaccgttcgcttaggcataaactgccggaacagttccctgctctttaatggtttaccgccaagatacggcttaagcgccatgcgggtaaagcgtttcgcggcgcgcagtgtgtctgcgtcaggaaattcccgcgcgtttaacgcttttaactgccttccggtgaacgttttattgtcgataacgacgcttgcgataaaccctttttcttcgcgataacgatacgtcatggtgtcatctaccggctcgccgctacccgcacaatgggtaaaattgacgccatagcccagatgcccgagcagtgccagttcaaagcggcgcaacgcgggttctggcgtaccagtgaccccggcaagagactgaatgcagtgcaagtaatcgaaaaagagttcagagaagcgcgtctcgtattccagtacgcgggagagaagttcgttgatgtacagaccgctgtaaagcgtgataccgcttaatggcagcgccagcgagacagcttcagcactgcgcagcgttttgacttcgccacgcccgccaaaacgtagcaagagaggggtgaaaggctgtaatgcccctttcagagtagagcgtttagagcgtgcgcctttggcaaccagacgcacgcgacccgattcctccgtgaagacgtccagcatcaggctggtttcgctccacgggcgactatgcaggacaaatgcgcgctgccagccttccatcggagttactcttaaagatcgtcaacataaccgagactgcgcagtgcgcgttcgtcgtcggcccaaccggatttcacttttacccacagctcaaggtgaacaggcgcttcgaacatttcctgcatgtctttacgcgcttcaatcccgatggttttgatcttggcccctttgttgccaatgaccatcttcttctgcccttcacgctcaacgagaatcaaaccgttgatgtcataaccgccgcgttcgttagagacgaaacgttcgatctccacggtcacggagtacggcagttcagcgccgagaaaacgcatcagtttttcgcggataatttcagacgccataaaacgctgtgagcgatcggtgatgtaatcttccgggaagtgatgggtcgcttcaggcagatgcttacgcacgattgccgcgatagtgtcgacattcagcccggtttcggcagagatcggcacgatatcgaggaagttcatctggcttgccaggaactgtaagtgtggcagcagatcggctttttcctgcacgttgtccactttgttcaccgcgaggattaccggcgctttgccatcacgcagcttgttgagcaccatttcatcgtccggcgtccagcgggtgccttctacgacaaaaatcaccagctcaacgtcgccgatagagctgctcgccgctttgttcatcaggcggttaatggcgcgtttttcttccatatgcaggccaggggtatcaacgtagatcgcctgatacgcgccttcagtatggatccccacaatgcggtgacgagttgtttgcgccttgcgggaggtgatggagatcttctgccccagcagtttgttcaacaatgtggatttgccaacgttcggacgtccgacgatagcaataaatccgcagtaacttttatcgatgctcattccagctccagttttttcaacgcctgttcggcggcagcctgctcagccttacgacggcttgaacctgtgccaaccaccggttcactcaggccgctgacctggcagtggatagtaaattcctgatcgtgcgcttcgccacgtacctggactaccagataagttggcagcggcagatggcgaccctgcaaatattcctgcagacgcgttttcggatctttttgtttatcgcctgggctaatttcgtccagacgagtttgataccagttgaggattaatttctcgacggtttgaatatcactgtcgaggaatacgccaccaattaatgcctcgacggtgtcggcgagaattgactcacgacgaaatccaccgcttttaagttcacctggccctaaacgtaagcactcacctaactcaaattcgcgcgccagttcagccagcgtattaccacggaccagcgtggcgcgcatccggctcatatcgccttcatccacacgagggaaacggtgataaagcgcattggcgataacgtagctcagaatagagtcacctaaaaattctaaacgctcgttatgtttactgctggcactacgatgagttaatgcctgctgcaacagttcctgatgattaaaagtgtagcccagcttccgttgaagccgattaattacgatggggttcatgcgataccaataaataaatgcgtcaacaattcagcacacgaaacagacctgatatacatggctcggctaactgcttcactgcagtttcagtttaccggtatatggggaccaacgctgtttcgtgtgccgtggcaacctggaggtgccaaccttaaacttcgggggaatattctatacacaacgacgggggatgtcgttagccacgggagatttatctcataaataattcacgttgtcgccataacggcgacaacgtgaacgaagatggctattaatggataccgccaatgcgacttaagcgcacaccagtcggccattcgccttcttgcttatcgaagctcatccagatagccgttgcccgaccgaccagattcgcttcaggcacaaaaccccagtaacggctgtccgcgctgttgtcgcggttgtcgcccatcatgaagtattgtcccggcggaacaatccaggttgccagttgttgccctggctgctggtaatacatccccacctggtcctgcgcaatcggcactgtcagaatgcggtgcgtcacatcacccaatgtctctttacgctcggaaagacgaattccattttctttggtttcgtttttcggcacttcaaagaatccgctggtcgcttccccaccattacggcgtgagaaggtctgaacgaaatcgctcggttccacgttggagtaagtgaccggtagcgcgttttcacacgcctggccggaactgcatcccggttgaatcgtcagctcttttgagaccggatcataagtgactttatcgcccggcaaacccaccgcgcgcttgatgtaatcaagctttggatcttccggatatttaaagaccacgatatcgccgcgtttcggatgaccggtttcgatcagcgttttctggtaaataggatctttaatgccataagcaaacttctctaccagaataaaatcaccgattaacagagtcggcatcatcgaacctgacgggatctggaacggttcataaataaacgaacgcacaatcaatacgatagccagtaccggaaaaacagaagcaccggtttccagccagccaggcttcggcgcaacctttttcagcgttgctttatccagtgagtcaccggcagccgcctgcgccgctgcctgacgttcccgccgtttaggtgcgaaaaagaatttatccacgcaccataaaatgcccgtcaccagtgtggcaatcaccagaatcagggcaaacatattcgccatgccaactcctaagggttatttgttgtctttgccgacgtgcagaatggcgaggaacgcttcctgcggcagctcgacgttaccgatctgcttcatgcgtttcttaccttctttctgcttctgcagcagctttttcttacgactgatatcgccgccataacatttagccagtacgtttttacgcagctgtttcacggtggatcgcgcaatgatgtgcgtaccaatcgctgcctgaatggcgatatcaaactgctggcgcgggatcagatctttcatcttctccaccagctcgcgaccgcggttttgcgaattaccacggtgggtgatcagcgccaacgcatcaacacgttcaccgttgattaatacgtctacacgaaccatgtcggacgcctggaagcgtttgaagttgtaatccagagacgcataaccacgcgaggtagatttcaggcgatcgaagaagtcgagcaccacttccgccatcgggatctcgtacgtcagcgccacctgattaccgtggtaaaccatattggtctgcacgccgcgtttttctacgcacagcgtaataacgttgccgagatatgcctgcggtagcagcatgtgacactctgcaatcggctcgcgcagttcgtaaatgttatttaccgctggcagcttggatgggctgtcgacgtagataacttctcttgacgtggtttcaacttcatacactacagtcggcgcagtggtgatcagatccagatcgtattcacgttccagacgttcctggatgatctccatgtgcagcaggccaaggaagccgcagcggaaaccaaagcccaacgcgctggagctttccggctcatagaacagtgaggcatcgttcaggctgagtttacccagcgcgtcacggaaggcttcatagtcgtcggaacttaccgggaacagaccagcatatacctgaggtttgactttcttaaagccaggcagcgccttttctgccggattacgcgccagtgttaaggtatcgcctactggagcgccgtggatatctttaatcgcacataccagccagcctacttcgccacatttcagttcagtacggtcaacctgcttcggcgtgaagatgcccagacgatcggcgttataggtctgcccggtgctcatgactttcactttgtcgcccttacgcagggtgccgtttttaatacggataagtgaaacaacgcccagatagttgtcgaaccaggagtcgataattagtgcctgcaacgggccttccggatcgccttccggcggcggaatgtcgcgcacaagacgttcgagaacgtcctgcacgccaacgccggttttcgctgaacagcgcaccgcgtcggtggcgtcgatacctacgatatcttcaatttcttccgccacgcgttcaggatcggctgccggcaggtcaatcttgttcagtaccggaacgacttcgagatccatttccattgcggtgtagcagtttgccagggtttgcgcttctacgccctgcccggcatcgaccaccagcagtgcgccttcacaggcagccagcgaacgggaaacctcataggagaagtctacgtggcccggggtgtcgataaagttaagctgataggtttcgccatcagacgctttgtagtccagcgtcacgctttgcgctttgatggtaatgccacgctcacgctcaagatccatggaatcgagaacctgcgcctccatttcacggtcagacaggccaccgcagatctggataatacggtcagacagcgtcgatttaccgtggtcaatgtgagctatgatcgaaaagttacgtatattcttcataaagtatgattattgtgccttaatgcccggttaaccaggcttttagaagtcgctgttctgagcttaacgtctgtattaatagaaacgccgcattctacactacaacattgaggcgaggaaatgttcataccgtatggattgtggtatctggaaacgtcctcgcatttgttatgcaaaatgcaacaaagccagtgaaatcactggctcgcgtcttccgaagatgtttcaaatcgcacaaggcctggcggcaatgccacgcttaagataatcggttgccattctgcccgggcagcaaacttacgcgaatagccgcgcgcaatcaggaacccgccaataccgccgaggatcgcaccacataatgctgcgacgtcagaagcaaagagtagctgaaatagcgaagcgatgaggaataatcccaccagcggcgacatataaaccagtaatgcggagctaagaaggctgccttcggcgatccccaattccactttttgccccggcactaacggctcatcacagggtacgacaatggtatgcgtggtttgcgggccaagtttattcaacacacggctaccgcaaccggcgcgtgaagcgcagctgctgcatgaggctttaacatcacaactgaccagcgcctgcccgttttcccaggagacgacggtagcccactctttgatcattgcgctgtcccgaacttaatattctcggcaatgcgtttcgccgtttgcggcggcagttcaccaacaatggtgatttcggcgttatcacgtacgcttgtactgacggttctgcgcccggtgcgcaacatctgatcggtgctcgatggcgtagcgcggttaacgtttaccgagaagctgaataatccgtcggaatagagacgtgattcgataggcatgttgtccatcgtcggtagcggacgtcgactactggaaacttcgctaaaaccctgtggcagccaggttggcgtccagctgaatttagctttttcaccgacaggaacagaaagcaacggcggcaaatttgccttcgccagcgtctgcatactgctgccgatatcctgattgacgttaaaagcaatcacgcgaaattgttccagcgtttcaccatcgcgatcaaggagatcaacccgcatcggtaatttcgattcggtgtccatccacacgatgtagctgtagcgtgtaccatctcgggcaaccacgcgaatgacttcgcaaagacgatcagcaatacgcgtgcgcccgacggagataaagtcgtagtaaggagaaaggcgtttgaaatcggtatagatgagcgatggcagagaatcaacaatgtaatcgccattaagcgtgaacggttcaagtcccggttcaaaatagctgatttcattgccgcgctgtaccacttcccggcgcgggccatccatttgcaacaattgtgcaagaggacggttatcgaggcgtgcatgtcgataacgcagagactcaacaccctgtttattgatgctgataaatgacagctcgtaattcagtgactgactggccaggttcatctgctgtaataacgccccggacgcgggagtggccgaggcgttagcagagaataacaggctacctgtcactaatgacatggcaaaccaaagttgcttcattactgcgattgcgttcctaaagtttgaattcctggcacctgtacagcggcttgctgagtttgtgcctgctcaaactgaagctgttcagagtggagtcggcgttgcagttcgtaatcctgcaacattgcattaatgcgacgacgctgctcctgtacctgctgctgttgaccattatttgtggtcgcttcagaaggtactcccagactaaccgggctggctttacccatcatcggcagtgtattaaatactggcgtttcgggctgctgggacgtttcagattgcccattatagtgctggacgccaacgataactgcaagcgatacgcatgctgctacgcccatttgagtaagctgtgccgcccacggacgtactttctgccagaatggcattttctgccattgatgcggcgcaggctgggcttccgggatcaatgtcgccggttgacgtactggctcttcttcaatggcggccatcacgcgtgaagagatatcgaaatggagcacctcgggagtatcaccccgcattgagtcacggattaagtgatagctttcccaggttttctgcatttctgggttatgagccagttcgttaagcagctcactatccagcgtttcgccatccattaaagcggaaagttgttctttctgcatgcctaatacccttatccagtatcccgctatcgtcaacgcctgataagcggttgaactttgttatcaatagcttccctcgctcggaagatacgtgaacgcaccgtacccaccggacaatccatgatagcggctatctcttcatagctcaggccatccagctcccgcaaggttattgccatgcgtaaatcttccgggagggactcaatagttcggaaaactatctgtctcagttcttctgacaacattaagttctcagggttcgaaatttctttcaacgcgccgccactttcgaagttttcagcttcaatggcatccacatcactggaaggtggacgacgcccctgagcaaccaggtaatttttcgctgtatttacagcaatccgatacagccatgtataaaaagcgctatctccccggaacgaatccagcgcacgataggctttaataaaagcttcttgtaccacatcgggaacatcacccgacggcacatagcgggaaaccagactcgccactttatgctgatagcgcactaccagtaagttaaaggctttctgatctcccttctggacccgttcaaccaggacctggtccgttaactgctcgctcatccgaggtaaagtctccccaaaccaaatttccacgcgctatcgaaacgccactccattagctgcaatttgagcaagcaaagggttagagtgtctcgtttttgtaaagttccgtaacgcatctgtttttgtttgtcatgctgtagacggatcattatctatcattataagtctacagaatctgaacatcgcattatctgtgtagaaatgcccatttaactgcctgaagagtaacccaacggcctttttatttcaccacctaatcctccaccagccagtaacttctcgttttctcgccgccctgagccagcgtgtttagtcactgtaacaaatattaaaatagcaggtgtttatttgcacaacatgatgttatgctgaccaaaccgtgtttagtaaattaaacaaagaaaatgaatactctccctgaacattcatgtgacgtgttgattatcggtagcggcgcagctggactttcactggcgctacgcctggctgaccagcatcaggtcatcgttctaagtaaaggcccggtaacggaaggttcaacattttatgcccagggcggtattgccgccgtgtttgatgaaactgacagcattgactcgcatgtggaagacacattgattgccggggctggtatttgcgatcgccatgcagttgaatttgtcgccagtaatgcacgatcctgtgtgcaatggctaatcgaccagggggtgttgtttgatacccacattcagccgaatggcgaagaaagctaccatctgactcgtgaaggtggacatagtcaccgtcgtattcttcatgccgccgacgccaccggtagagaagtagaaaccacgctggtgggcaaggcgcagaaccatccgaatattcgcgtgctggagcgcagcaacgcggttgatctgattgtttctgacaaaattggcctgccgggcacgcgacgggttgttggcgcgtgggtatggaaccgaaataaagaaacggttgaaacctgccacgcaaaagcagtggtactggcaaccggcggtgcttcaaaagtttatcagtacaccaccaatccagatatttcttctggcgatggcattgctatggcgtggcgcgcaggctgccggattgccaatctcgaatttaatcagttccaccctaccgcgctgtatcacccacaggcacgcaatttcctgttaacggaagcactgcgcggcgaaggcgcttatctcaagcgcccggatggcacgcgttttatgcccgattttgatgagcgtggcgaactggctccgcgcgatattgtcgcccgcgccattgaccatgagatgaaacgcctcggcgcggattgtatgttcctcgacatcagccataagcccgccgattttattcgccagcatttcccgatgatttatgaaaaattgctcgggctggggatagatctcacgaaagaacccgtgccgattgtgcctgctgcacattatacctgcggtggtgtaatggttgatgatcatgggcgtacggacgtcgagggtttgtatgccattggcgaagtgagttataccggcttacacggcgctaaccgcatggcctcgaattcattgctggagtgtctggtctatggctggtcggcggcagaagatatcagcagacgtataccttatgcccacggcgtcagtacgttaccgccgtgggatgaaagccgcgttgagaaccctgacgaacgggtagtaattcagcataactggcacgagctacgtctgtttatgtgggattacgttggcattgtgcgcacaacgaagcgcctggaacgcgccctgcggcgaataaccatgctccaacaagaaatagacgaatattacgcccatttccgcgtctcaaataatttgctggagctgcgtaatctggtacaggttgccgagttgattgttcgctgtgcgatgatgcgcaaggagagccgtggcctgcatttcacgctggattatccggaactgctcacgcattccggtccatcgatcctttctgccggcaatcattacataaacagataaaaagcctgggtcagcgccgtatacgcttcggaatagttctggtctggcccacgaatgactaagcgatcgctaaagcattctcccgcctgcggggagaatgccagcagcacccgatgcggcagtcgcgcttcgttttccgccacatccgtccgcaaacgtaaatgccagcccatacttaatgccagttcagtaaaaccattaccaatctgctctggcagcaccacgcagaaaaatccctcttcggtaatgcactccgccgcacaagtcagcaacgatgggtgatcaagcgtagtggtatagcgagcctgttcccgttgaggtgtcgcgcactctactccctgctgatagtaaggtgggttgctgatgactaaatcgaagcgtactgtctgctgtgtgatccactgcagaatatccgccgtatggacgttaatccgctctgcccacggggactggttgatattttcctgcgcttgcgcggcagcttcactttccagttcaactgcatcaatcatcacgctgtcatctgttcgctgcgccagcattaatgccaacaacccgctacccgcgccgatatcaaggcaacgttttaccccagccacaggtgcccatgcgcccagcaaaatgccatccgttcccactttcatcgcacagcgatcgtgagcaacaaaaaactgtttaaaagtaaatccattacgacgaaacacggatgtagactgtgacatgaaaataaaaccttgcaggaaaaacggcgatagcaccgggtgagaacaatacccgagaagcgatatccatacaaacagatgaagattgcagccgtaacgtctataatcagcgccccacacagaggtagaacatgactgtaacgactttttccgaacttgaactcgacgaaagcctgctggaatccctccaggataaaggtttcactcgcccgaccgccattcaggctgccgccattccgcctgcgctcgatggccgtgatgtactcgggtctgcgccgacaggcaccggtaaaacggcggcgtatctgctgccagcgttgcagcacctgctcgatttcccacgtaagaaatccggtccgccgcgtattttgatccttaccccgactcgcgaactggcgatgcaggtggccgatcatgcccgcgaactggcgaaacatacgcatctggatattgccaccatcaccggcggcgtggcctatatgaaccacgcagaagtgttcagcgaaaaccaggacattgtggtcgccacgaccggacgtctgctgcaatacataaaagaagagaacttcgattgccgcgcggttgaaacgctgatcctcgacgaagcagaccgtatgctggatatgggcttcgcccaggatatcgaacatattgctggcgaaacgcgctggcgtaaacagaccctgctcttttcggcaactctggaaggcgatgcgattcaggactttgccgagcgtctgctggaagatccggtggaggtttctgccaatccgtccacccgtgagcgcaaaaaaattcatcagtggtattaccgcgccgatgatcttgagcataaaaccgcgttgctggtgcatctgttaaaacagccggaagcgacccgctcaattgtgtttgtgcgtaagcgtgagcgtgtgcatgagctggcaaactggctgcgcgaagcaggcatcaacaactgctatctcgaaggtgagatggtacaaggcaagcgtaacgaggcgattaaacgcttgaccgaaggccgcgtaaacgtactggttgctaccgatgttgccgcgcgcggtatcgacattcctgacgtcagccacgtctttaacttcgatatgccgcgcagtggcgatacttatttgcaccgtatcggacgtaccgcgcgcgccggtcgtaaaggcaccgcgatttcgctggtggaagcccatgaccatctgctgctgggcaaagttggccgttatattgaagagccaattaaagctcgcgtaattgatgagttacgtccgaaaacgcgtgcgccaagcgagaagcagaccggcaagccatcgaagaaagtgttggctaaacgtgccgagaagaaaaaagctaaagagaaagagaagccgcgggtgaaaaaacgccatcgcgacactaaaaatattggtaagcgccgtaaaccaagcggaacgggcgtgccaccgcaaacgacagaagagtaatctcaatgccgggtttaagcccggcattgtttttatcccggcaaaaaacactcttcaacacactgaataaaagtgtgcatcgccgggctaaccgcttttccggcatggtgagcgcacatggccgtaatggtttgcgactgttcgccaaaaggcaattcaattaattctccgcactccaactcttttaccaccgcaaaacgcggcaggtaactgactccgatatttgccgcgacacaacgcttgatgctttcgatacttataagctcaatggtgttttccaccgtgatccgccgctggcacagcgtgctctcaaatatctgccggaagacacattgtggttcgttgataataaagctacaggcgttatgtcttcccggctcagtaaaatcgacatctgcaatttgcggtgaagccaccagcaccagcggttgttcacccaactctcgtcggttcagagcatcatcattccctacgcgataaaaaaccccgacatcggcctcatcattcagtagcgcatcacggatcacgtaacagttcagcgactgcaacgataaacgcacttttggagcgcgttgccgaaaacgctgcaacacctgcggcattcggtaagagagcaacgtttcgcctgaaataacgcgtagttccccgtccggatccgactcttttttagcagcctcacgaagcgtatccatcactcgggtaagttcatagatgtgcggcagcagcttttttccttcgcgggtaaggcacattcgtcgaccaattttctcaaacaactgtaccgagaactcctgttcaagctgctgaatatgaaaagtcaccgtcgattgtgtgcagcacaatttttgcgaagctcgcaaaaaggaaccctcttccaccacggttttaagcgtaataaaacggcgcagatccataaccccaaacctatcgaaaatatcgaatttagaatgtaaaaacattcatttttttaaatgttccgtgtcgggtactgtctaccaaaacagaggagataacaagtgacaccgacccttttaagtgctttttggacttacaccctgattaccgccatgacgccaggaccgaacaatattctcgcccttagctcagctacaacgcacggatttcgtcagagtactcgcgtgctggcagggatgagtctgggatttttaatcgtcatgttgctatgcgcgggaatttcgttttcactggctgttatcgacccggcagcagtgcatctgttgagttgggcgggggcggcatatattgtctggctggcgtggaaaatcgttaccagtccaacaaaggaagatgggcttcagacaaaaccaatcagtttttgggccagctttgctttgcagtttgtgaacgtcaaaatcattttgtatggcattacagcactgtcgacgtttgtcctgccgcaaacgcaggcgctaagctggataattggcgtcagcgttttgctggcgatgattgggacgtttggcaatgtgtgctgggcgctggcggggcacctttttcagcgattgtttcgccagtatggttgccagttgaatatcgtgcttgcactgttgctagtctattgcgcggtacgcattttctattaacgaaaaaaagcggaagaagtcgccctcttccgcttagtaacttgctacttaagccttacaggctttcagtaaaggtacgagcaataacgtcgcgctgctgttccggagtcagagagttaaagcgaactgcataaccggatacacggatggtcagctgcggatatttttccggatgcttaactgcatcttccagagtttcacgacgcagaacgtttacgttcagatgttgaccaccttcaacgcgaacttctggtttcacttctactggaacttcacggtactcaatgtcacccagtttgcttactgcaaccacttcatcttctgcataacctgcttttgcaacgatgcaacgcgcttcgcctttttcgctgtccagcagccagaaagagttcagcagatcgtcgttagcggctttagtaatctggatacctgtaatcatgtgatgcctccccggcaaaattatttgatttgttcagcctgtcgcggccaattggtaaaaccattgttgcttgagtgtatatatactcctcaaacacccttgaatctttgatttaaatcaataaaaaccacacatcaagtatggttgcaaatggattttattgttttacatcaacttatgcaggtgtgaaattttaccaatttacatttttttgcactcgtttaagtctaaaaaatgagcatgattttgttctgtagaaagaagcagttaagctaggcggattgaagattcgcgggagagcgagatggcaaacgaattaacctggcatgacgtgctggctgaagagaagcaacaaccctattttcttaataccctacagaccgtcgccagcgagcggcagtccggcgtcactatctatccgccacaaaaggatgtctttaacgcgttccgctttacagcgttgggtgacgttaaagtggtgattctcggccaggatccttatcacggaccgggacaggcgcatggtctggcattttccgttcgccccggcattgcgacaccgccgtcactgctgaatatgtataaagagctggaaaatactattcccggtttcacccgccctaatcatggttatcttgaaagctgggcgcgtcagggcgttctgctactcaatactgtgttgacggttcgcgcaggtcaggcacattcccacgccagcctcggctgggagaccttcaccgataaagtaatcagcctgattaaccagcaccgcgaaggcgtggtgtttttgttgtggggctcacatgcgcaaaagaaaggggcgattattgataagcaacgccatcacatactgaaagcgccgcatccatcaccgctttctgcgcatcgtgggttctttggctgcaaccattttgtgctggcaaatcagtggctggaacaacgtggcgagaaaccgattgactggatgccagtattaccggcagaaagtgagtaaatttgcaggaaaacgccggatggcagcgttgccacccggctgatttatcaggctttattctgacgccaccattcaccaagcaaaacgccggttgcaacagagatatttagcccggcaacgttgccagtaccatcaatcttcacgcgcaaatcgttcggatcgcgtgcggcatccggtaacccttcatattcctgacccagcaccagtaccattttcgctggcagactggttttgaacagcggtttcccctgctcgctggaagtggtcactacggtgtaacctgcctgacggaaatcatccagcacgttaacaatgttgtcgccagtaatcggctgaacgtgctctgcgccgccttctgcggtacggatagccgcccccgactccagcagtgccgcatcctgcaccacaacgcctttcacgccgaagtgcgcgcagctgcgcatcatgccacccaggttatgcgggttagattcgttttccagcgccagtacacaatcctgcgcgcctgcctggcttacccactgctgcacggttgtaccgttacgctttttgatcaggaagcaaacgccgccgtgatgttccgtgcctgacgcttttgtcagttccgcttcatctaccacatggtacgctttgcggtttgctgccatccagcgcaaggcttctttaaaacgcggcgttacactctggataaaccaggcgcgaacaatcgcttccggacggctctggaacagtgcctgacaggcattttcgccgtagacgcgggtttcttccgcacgctgacgacgcaacacttccggatcaataaaacttttaccactgatgccaccgtgatcggccttttccggcgtctcatcacccggcgcgcgggaaactgtgcgccacggcgactcttcccacttgcggtcacggggctgactctgtttgtcatcgcgggcggggcgacggccaccgtcagcacgagattttcctggacgcccgccccctttcccggtacgcgggttgtgggtacgtttatcagaatcatcatcactgcggacatacatcactttgaccttgccgcttttacctttcatttcatcgttcatgcttttctccaccagcgctgcgcgaagcgcgcagattacccgaagtccgcgcggttcgccatgatttcgtaccaaagcctgcgactatcatacctattgaataaaacagattgttgtctggaacaatgtccccgataatatgtaacatattagaaacataccggcgtcgttgccgataagtctccttactcatcccgaggttagttatgaataccgtttgtacccattgtcaggccatcaatcgcattcccgacgatcggatcgaagatgcggcaaaatgcggacgctgcggtcacgacttgtttgacggagaggtgattaatgcgaccggtgaaacgctcgacaaattgctgaaagatgatctacctgtggtgatcgacttctgggcaccgtggtgcggcccctgccgtaatttcgcaccaatttttgaagatgtcgcgcaagagcgtagcggtaaagggcgctttgtgaaagtgaataccgaagctgaacgtgaattgagcagtcgctttggaattcgtagtataccgacgatcatgattttcaaaaacggtcaggttgtcgacatgcttaatggcgcagtaccgaaagcgccgttcgacagctggctgaacgaatctctttaatcttaccggggcgcatcttgtgccccgttttctcctctgcgacaatggcgttttttcgacgctctcttatgaccgaaaacgctgttctccagttacgcgccgagcgtattgcgcgcgcaacacgtccttttcttgcccgcggtaatcgcgttcgtcgctgccaacgctgtcttttgccagagaaattatgtctctgttcgacaattaccccagcacaagcaaaaagtcgcttctgtttgctgatgttcgacaccgagccaatgaagcccagtaataccgggcgtctgattgctgatattttgcctgataccgttgcgtttcaatggtcgcgtacagaaccctcgcaagatttgctggagctggtgcaaaacccggactatcaaccgatggtggtttttcccgcctcgtatgctgatgagcaacgggaagtgatcttcacaccacctgccggtaatcctccgctatttatcatgctcgatggtacctggccagaagctcgcaagatgtttcgtaaaagtccgtatctggataatcttcccgtcatttccgtcgatctttctcggctttctgcctatcgcctgcgtgaagcccaggctgaaggccaatattgtactgccgaggtagccatcgcactgttagatatggccggcgataccagggcggcgacagggttaggcgagcattttacccgctttaaaacacgctatctggcaggaaaaacgcaacatccgggaagcatcacagcagaacagttagaaagcgtttaaaatcattcggtcacttctgcgggagaccggtatgagtcagcgaggactggaagcactactgcgaccaaaatcgattgcggtaattggcgcatcgatgaaacccaatcgcgcaggttacctgatgatgcgtaacctgctggcgggaggctttaacggaccggtactcccggtgacgccagcctggaaagcggtgttgggtgtgttggcctggccggatattgccagcttgccctttacacccgaccttgcggttttatgtaccaatgccagccgtaatcttgctcttctggaagagctcggcgagaaaggctgtaaaacctgcattattctttccgccccggcatcgcaacacgaagatctccgcgcctgcgccctgcgccataacatgcgccagctaggaccaaacagtctgggcttactggctccctggcaaggtctgaatgccagcttttcgcctgtgccgattaaacgcggcaagctggcgtttatttcgcaatcggctgctgtctccaacaccatcctcgactgggcgcaacagcgtgagatgggcttttcctactttattgcgctcggcgacagcctggatatcgacgttgatgaattgctcgactatctggcgcgcgacagtaaaaccagcgccatcctgctctatctcgaacagttaagcgacgcgcgacgctttgtttcggcagcccgtagtgcctcgcgcaataaaccgattttggtgattaaaagcggacgtagcccggcggctcaacgtctgttgaacaccacggcaggaatggatccggcgtgggatgcagctattcagcgtgccggtttgttgcgggtacaggacacccacgaactgttttcggcggtggaaacccttagccatatgcgcccgctgcgtggcgaccggttgatgattatcagcaacggtgctgcgcctgccgcgctggcgctggatgccttatggtcacgcaatggcaagctggcaacgctaagcgaagaaacctgccagaaactgcgcgatgcactgccagggcatgtggcaatctctaacccgctcgatctgcgcgatgacgccagcagcgagcattatgtcaaaacgctggacattctgctccacagccaggattttgatgcgctgatggttattcattcgcccagcgccgctgctcccgcaacagaaagcgcgcaagtattaattgaagcggtaaagcatcatccccgcagcaaatatgtctctttgctgacgaactggtgcggcgagcactcctcgcaagaggcacgacgtttattcagcgaagccgggctgccgacctaccgtaccccggaaggaaccatcaccgcttttatgcatatggtggagtaccgacgtaaccagaagcaactacgcgaaacgccggcactgcccagcaatctgacttccaataccgcagaagcgcatcttctgttgcaacaggcgattgccgaaggggctacgtcgctcgatacccatgaagttcagcccatcctgcaagcgtatggtatgaacactctccctacctggattgccagtgatagcaccgaagcggtacacattgccgaacagattggctatccggtggcactgaaattgcgctcgccggatattccacataaatcggaagttcagggcgtcatgctctacctacgtacagccaatgaagtccagcaagctgcaaacgctattttcgatcgcgtaaaaatggcctggccgcaggcgcgggtccacggcctgttagtgcaaagtatggctaaccgtgctggcgctcaggagttgcgggttgtggttgagcacgatccggttttcgggccgttgatcatgctgggtgaaggcggtgtggagtggcgtcctgaagatcaagccgtcgtcgcattaccgccgctgaacatgaacctggcccgttatctggtcattcagggaataaaaagtaaaaagattcgtgcgcgcagtgcactgcgtctattggatgttgcaggcttgagccagcttctggtgcaggtttccaacttgattgtcgattgcccggaaattcagcgtctggatattcatcctttgctggcttctggcagtgaatttaccgcgctggatgtcacgctggatatcgcgccttttgaaggcgataacgagagtcggctggcagtgcgcccttatccgcatcagctggaagaatgggtagaattgaaaaacggcgaacgctgcttgttccgcccgattttgccggaagatgagccacagcttcagcaatttattgcgcgagtcaccaaagaagatctttattaccgctactttagcgagatcaacgaatttacccatgaagatttagccaacatgacgcagatcgactacgatcgggaaatggcatttgtagcggtacgacgaattgatcaaacggaagagatcctcggcgttacacgtgcgatctccgaccctgataacatcgatgccgaatttgccgtgctggttcgctcggatctcaaagggttaggcttaggtcgacgcttaatggaaaagttgattacctatacgcgagatcacggactacaacgtctgaatggtattacgatgccaaacaatcgtggcatggtggcgctggcccgcaagctcgggtttaacgttgatatccagctcgaagaggggatcgttgggcttacgctaagtcttgcccagcgcgaggaatcatgagtaaggtactggaaatgttgaccacttaatcgggactggtgttattattgcccgcttatgtcgtctgcattgcacagaggacccttcaatgaacagagaagaaatgcactgtgatgttgtcaaaatttaagcgtaataaacatcaacaacaccttgcccaactacccaagatttctcaatcagttgatgatgtcgatttcttttacgctcccgccgacttccgggagacgttgctggaaaaaatagccagcgcgaagcagcgcatttgcattgttgccctgtatctcgaacaggatgacggtggcaaaggcattctgaacgcgttgtatgaggctaaaaggcagcatccggaactggatgtgcgggtgctggtcgactggcatcgtgcacaacgtggacgcattggcgctgcggcatctaacactaacgctgactggtactgccgcatggcgcaggaaaatcctggcgtagatgttccggtttatggcgttccaatcaatacccgtgaagcccttggtgttctgcactttaaaggctttatcatcgacgatagcgtactttatagcggtgccagcctgaacgatgtttacctgcatcagcacgataaatatcgctacgaccgttatcatctgatccgtaaccgtaagatgtcagacattatgtttgaatgggttacacagaatattatgaatggccgcggcgttaatcgtctggatgatgttaatcggccaaaaagcccggaaatcaagaacgacattcgcctgttccgccaggagctgcgtgatgccgcttatcatttccagggcgatgccgacaacgatcagctttccgtaacgccgctagtggggctggggaaatcgagtctgttgaacaagaccattttccatcttatgccttgtgccgagcagaaactaaccatctgtacgccatacttcaacctgccagcaatccttgtgcgcaatattatccagttgctgcgcgaagggaaaaaggtcgaaattattgttggtgataaaaccgcgaacgacttctacattccggaagatgaacctttcaagataattggcgcattgccttatctctatgagatcaatctgcgtcgtttcctgagtcgtttacagtattacgtcaacactgaccagttagtagttcggttatggaaagatgacgacaacacctatcacctgaaagggatgtgggttgatgataagtggatgttgatcaccggtaataacctgaacccgcgcgcctggcgtctggatctggaaaacgccattttgatccacgatccgcaactggagcttgcgccacagcgagagaaagaactggatctgatccgcgagcataccaccatcgttaagcactaccgcgatctgcaaagtattgccgattatccggtgaaggttcgtaaactcatccgccgtttgcgccgtatccgcatcgaccgattaattagccgcatcctgtaatcacaaccccgtcctgtacggggtttgttttttggaggccacgttttgcgtattctttttgtctgttcgctattgttactttctggatgcagccatatggctaacgatagctggagcgggcaggataaagctcaacactttatcgcctcggcgatgctttccgccgccggaaatgaatattcacagcatcaggggatgagccgggatcgcagtgccatgtttggattgatgttctctgtcagtctgggggcgtcaaaagagctttgggatagccgccctgaggggagcggctggagctggaaggattttgcctgggatatcgccggtgcaagcaccggctataccgtctggcaactgacccgtcactaaagccgcatcccttttcctttacggtgcaatgttagtgaaaccagaaacgccaccacggccatcaaggtcacataccagaagaaggctgtttccattcctattgatttcagcgacaacgctacgtactccgccgacccaccaaatatagcattggcgaccgcatatgacagaccaacgcctaatgcgcgaacctgtgccgggaacatctcagccttcagtattccactgattgaagtataaaaactcactatcagcagggcgcacatcaccagaccaaaagcggcataaggcgaggaaacgttctgcaatgctgagagaataggaacggtaaaaatggttgccagagaaccgaaacataacattgaggtacggcgaccaatcttatccgacagcgcgccaataagtggttgaataagcatgaatacaaacaatgcggcagtcataatgccactcgccacgttggcatgcattcccgcagtatttaccagatacttctgcatataagtggtgaaggtatagaaacaaagggagcccgcagcggtaaaaccgagaaccatgatgaatgcacggcgattgcgccataatcctttcagagatccagcttcttttaaagcgcgtgtttcttgttgtgaagtttcatctaactgacgacgtaaccacaacgccacaacagctaacacagctcctaacgcgaaaggaatacgccatccccactctctgagtacggcgtcttccatggtgtgttgtaaaaccacgacaaccagtagagctagcagttgcccgccgatcaacgtcacatactgaaatgatgcgtaaaaacctttgcgcccttcaacggcaacttcactcatataggtggcgctggtaccatattctccgccaacggataatccctggaataaacgcgcgagaagcaataatgccggagcccaggtaccgattgtttcgtagcctggcaaacaggcgataaccagtgagccgaaacacatcatacacaccgataacagcatcgattttttgcgaccatgtttatcggctatgcggccaaatagccaaccgcctattgggcgcatcagaaatcctgcagcaaaaacacctgctgtttgcagtagttgggtcgtcgtgttcccggaagggaagaagatgtgggcgaagtagagtgaacagaacgagtagacatagaaatcgaaccactcgaccagattacctgaagaggccccaacaattgcccaaatgcggcgacgagtatcactacttgtcagtttgctgtctgccgttacagtactttcagccatgccattatgtctcctgccgtaatccgatgcttttgtcggtcgcttttgtttattttttggtaagggaaatgttatacatttgttgcatatcattatgcaaccttaaccatgaatttagttagcaggaaaatggttattaaggagctggtaatgactccaacttactgatagtgttttatgttcagataatgcccgatgaccttgtcatgcagctccaccgattttgagaacgacagtgacttccgtcccagccttgccagatgttgtctcagattcagattatgtcgctcaatgcgctgagtgtaacgcttgctgataacgtgcaactttcccttcaggcgtgattcatacagcggccagccatccgtcatccataccacgacctcaaaggccgacagcaggctcagaagacgctccagtgtggccagagtgcgttcaccgaagacgtgcgccacaacagtcctccgtatcctgtcatacgcgtaaaacagccagcgctgacgtgatttagcaccgacgtagccccactgttcgtccatttcagcgcagacaatcacatcactgcccggttgtatgcgcgaggttaccgactgcggcctgagttttttaagtgacgtaaaaccgtgttgaggccaacgcccataatgcgtgcactggcgcgacatccgacgccattcatggccatatcaatgattttctggtgcgtaccgggctgagaggcggtgtaagtgaactgtagttgccatgttttacggcaatgagagcagagatagcgctgatgtccggcagtgcttttgccgttacgcaccacgccttcagtagcggagcaggaaggacatctgatggaaatggaagccacgcaagcaccttaaaatcaccatcatacactaaatcagtaagttggcagcattacctaaggagcttaaggatagatttctggtaaggaggaagtatggaagtgggcaatttggggaagacgtattcgctgttgaatctggcttatgtgggagcgtagatacagttacggccagcaagttttttcctggtccagtctcccggattgcaggcatgccagacacagcgccgtcaggcgctgttgtttcatcccttccgcgatttttacgcagctaccggattatgccgtgacgcatcgaacggcacgcctgacttcagcactccatacgccacctgtgccagcttgcgcattatcgagccgagaatcacctttcctttcttgccattagctgccaacgcccgtccccactcagtcttactggtggctaccattgcaggcatatacaacggcctgcgaagcgacacatgtccggctttactcaaccggcttgcccctctcacactactgcctgattcataacgccgtggtgtcagacccgcaaaagcggcgaactgtctggcatgggcaaaacggtccttcagaccatgtaagccagcaataccgcagatgttttctctccgatacccgggatgctttccagcagtttcctgcggtgtttcatatccggatcatcgtctgtcaggtcttttatctgcttctcaagacgcttcagctctgcttcaagccacagaaggtgagcatcaatgctcggcctctggacttcccgcgccgtttcagtgcgattcagttcctgcctgtgcatatctgtcagcgcctggtggcgtactaccagggcatgcaacgcgcgttcaagcgggtgatgcgcttcccaggctgcagggcgcttctgacgacagaactctgccagcatgcggcatccacggtatcagtcttgttacgcagtccttcactctgagcgaaagctttacccagtgcaggattaatgactgacactatgtagcctgcatcgtaaaggcactctgcgacaggttccatataggtgccggtcgcttcgatgcagatatgcgcatggtcaatcttgtgacatttcagccaactcaccagctcatcgtgccctttagtggtgttagcgaattttttggtgcgatgacgaccatcagaacgcaacacatcgacatccagtttctctttagcggtgtcgataccgatataatgaagttcatgttccatagtgaaaccaaccttgcaaatacggattaccgggaaaaccggtctatgatactgtccggtttatcacttcgggagaaaggcagtccgccgcataaatctaccatgcaggttagaacccaaggccggatacggcatgcggactgcaggcagagaaaactggccgattttctctgcactggagggataatacaaggtcggataagatgcggcatgaactgaaccccaaaacctggacagtttcagttaaccggctttttgatactcagtccggtattctaccgggctgagtcccccaagactgagttttattcttttttgattccagtaagttatgtattcgttaacggcattttccagctcttctacatttctgtagtcccggcgatagtacatttcttctttcaggtgaccaaagaagttctccattaccgcattatcaaggcagttgcccttgcgcgacatgctctgcactaaccctctgtccgccagggcggactgataactttttatccggtaatgccatccttgatcactgtggagcagcggtttctccccttcagcaaggctttccagccccttatttaacatccgcttcaccagctcctctgtaggcctgcaggccgtttcccacgccacgatttccccgttaaacaaatcaagtatcggggacaggtacagtttttgtccgccagccctgaattcggtgatatctgtcacccatttctcacagggagcttccgctttgaactgtcgctgaaggatattttctgcagcgagtcccatatttccccggtaagaccggtatttcttcaggcgcacaggagacttcaggccgagctgttgcatcagttttcgcaccgttttgccactgaacttaagacctcttttctgaagctcacaatggatccgccggtacccataatatccccggtgttcatggaagatggaggctatgagctgtttcacatcagcatacttgtccttagccttctgcagtgacagctggtagtacagcgtgcttctggccagtcctgcggcctttaacaggtcagactggcagtgtccgtacctcaggctctggatgactttcgttttttctccagctcctggcgctttttttccagaagatgctcctgcatggctttcagatatgcattttctgcgcgaagataacgcagctcattcttcatctcttccggcgtcatgtttgcctcgttttcatgggtatcatcagaacgggtcatgcttttctccttcctgcgcctgataaaggcctcattaccagatttgcggtagccttttatccagtttttaaccgtgttgtggctgggaatgttaaaccgggcagctacccggggtagagactcagaatgcccgagagcataaagaaccacgcaaagtttatcttcaggagaatagctacgcttgtgtctgcaatccagtgccgaggaccgtgaagaagaaaaagattaatccagtgtgagaggctggtgtgagaaagttgaaagagttttgccgtagaaatgatgcctgcatgaccagccaggtaatgatttacagcggcaagttttatttcaaatgaatgtttcataaactgcaccttcagatgtcagattatgtccaacatttggggtgcagttcagcagcgtcgcatccggcattttttctgtgccaatgcaaaaaggccatcctgacggatggccttctgcttaatttgatgcctggcagttccctactctcgcatggggagaccccacactaccatcggcgctacggcgtttcacttctgagttcggcatggggtcaggtgggaccaccgcgctaaggccgccaggcaaattctgtttatcagaccgcttctgcgttctgatttaatctgtatcaggctgaaaatctttctctcatccgccaaaacatcttcggcgttgtaaggttaagcctcacggttcattagtaccggttagctcaacgcatcgctgcgcttacacacccggcctatcaacgtcgtcgtcttcaacgttccttcaggagactctaagtctcagggagaactcatctcggggcaagtttcgtgcttagatgctttcagcacttatctcttccgcatttagctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctggcttatgccattgcactaacctcctgatgtccgaccaggattagccaaccttcgtgctcctccgttactctttaggaggagaccgccccagtcaaactacccaccagacactgtccgcaacccggattacgggccaacgttagaacatcaaacattaaagggtggtatttcaaggtcggctccatgcagactggcgtccacacttcaaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttcgcgttgccgctaaccccatcaattaaccttccggcaccgggcaggcgtcacaccgtatacgtccactttcgtgtttgcacagtgctgtgtttttaataaacagttgcagccagctggtatcttcgactgatttcagctccacgagcaagtcgcttcacctacatatcagcgtgccttctcccgaagttacggcaccattttgcctagttccttcacccgagttctctcaagcgccttggtattctctacctgaccacctgtgtcggtttggggtacgatttgatgttacctgatgcttagaggcttttcctggaagcagggcatttgtcgcttcagcaccgtagtgcctcgtcatcacgcctcagccttggttttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcaaccctcacaggccaccttcacaggcttacagaacgctcccctacccaacaacacatagtgtcgctgccgcagcttcggtgcatggtttagccccgttacatcttccgcgcaggccgactcgaccagtgagctattacgctttctttaaatgatggctgcttctaagccaacatcctggctgtctgggccttcccacatcgtttcccacttaaccatgactttgggaccttagctggcggtctgggttgtttccctcttcacgacggacgttagcacccgccgtgtgtctcccgtgataacattctccggtattcgcagtttgcatcgggttggtaagtcgggatgacccccttgccgaaacagtgctctacccccggagatgaattcacgaggcgctacctaaatagctttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccctgcaacttaacgcccagttaagactcggtttcccttcggctcccctattcggttaaccttgctacagaatataagtcgctgacccattatacaaaaggtacgcagtcaccccattaagaggctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcatcgagctcacagtatgtgcatttttgtgtacggggctgtcaccctgtatcgcgcgcctttccagacgcttccactaacacacacactgattcaggctctgggctcctccccgttcgctcgccgctactgggggaatctcggttgatttcttttcctcggggtacttagatgtttcagttcccccggttcgcctcattaacctatggattcagttaatgatagtgtgtcgaaacacactgggtttccccattcggaaatcgccggttataacggttcatatcacctcaccgacgcttatcgcagattagcacgtccttcatcgcctctgactgccagggcatccaccgtgtacgcttagtcgcttaacctcacaacccgaagatgtttcttgcgattcatcatcgtgttgcgaaaatttgagagactcacgaacaactctcgttgttcagtgtttcaattttcagcttgatccagatttttaaagagcaaatatctcaaacatcacccgaagatgagttttgagatattaaggcaggtgactttcactcacaaaccagcaagtggcgtcccctaggggattcgaacccctgttaccgccgtgaaagggcggtgtcctgggcctctagacgaaggggacgtatcagtctgcttcgcaagacgccttgcttttcactttctatcagacaatctgtgtgagcacttcaaagtacgcttctttaaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcatggagtcgagttgcagactccaatccggactacgacgcactttatgaggtccgcttgctctcgcgaggtcgcttctctttgtatgcgccattgtagcacgtgtgtagccctggtcgtaagggccatgatgacttgacgtcatccccaccttcctccagtttatcactggcagtctcctttgagttcccggccggaccgctggcaacaaaggataagggttgcgctcgttgcgggacttaacccaacatttcacaacacgagctgacgacagccatgcagcacctgtctcacggttcccgaaggcacattctcatctctgaaaacttccgtggatgtcaagaccaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccacgcctcaagggcacaacctccaagtcgacatcgtttacggcgtggactaccagggtatctaatcctgtttgctccccacgctttcgcacctgagcgtcagtcttcgtccagggggccgccttcgccaccggtattcctccagatctctacgcatttcaccgctacacctggaattctacccccctctacgagactcaagcttgccagtatcagatgcagttcccaggttgagcccggggatttcacatctgacttaacaaaccgcctgcgtgcgctttacgcccagtaattccgattaacgcttgcaccctccgtattaccgcggctgctggcacggagttagccggtgcttcttctgcgggtaacgtcaatgagcaaaggtattaactttactcccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgcctaggtgagcctttaccccacctactagctaatcccatctgggcacatccgatggcaagaggcccgaaggtccccctctttggtcttgcgacgttatgcggtattagctaccgtttccagtagttatccccctccatcaggcagtttcccagacattactcacccgtccgccactcgtcagcaaagcagcaagctgctttctgttaccgttcgacttgcatgtgttaggcctgccgccagcgttcaatctgagccatgatcaaactcttcaatttaaaagtttgatgctcaaagaattaaacttcgtaatgaattacgtgttcactcctgagacttggtattcatttttcgtcttgcgacgttaagaatccgtatcttcgagtgcccacacagattgtctgataaattgttaaagagcagtgccgcttcgctttttctcagcggcgcggggtgtgcataatacattttcccgctacagagtcaagcatttatttttgctttctctgccggaattctcaggagaatcccgctgacccggcggcgtgcttgccgttgttccgtgtcagtggtggcgcattatagggagttattccggcctgacaagcaaaaaatataaaaactttattgttcgctcattttccaggcaaaacatctttaatatagtcttttccgtctaacttatagacaaaaacgagccccgaaggctcgttttatcattactggacggcgacgatccggtcttcattaacttccaggcgaataactttacccggaaccaattcaccagacagtatttgctgtgccagcgggttttcgatctgctgctggatagcacgcttcagaggacgtgcaccatagaccggatcgtaaccgttctcgctcagcagtttcagcgcctcgtcagaaatgtggatttcataaccacgttcttccagacgtttgtacagacgtttcaactgaatctgcgcaatcgacgcaatgtgttgttcacccagcggatggaagacgacgacttcatcgatacggttaatgaattccggacggaagttatggcttaccacaccgagcaccagctctttcatgtgcgcataatccagttcaccaaaacgttcctgaatcagatcggaaccgaggttagaggtcataatgacgaccgtattacggaagtcgaccgttctcccctgcccgtcagtcagacgcccatcatccagtacctgcaacagaatgttgaagacatccggatgcgctttttccacttcatccagcaggatgacggaatacggacgacgacgcaccgcttcggtcagatagccaccttcttcataaccaacatatcccggaggcgcaccaaccagacgagacaccgagtgtttctccataaactcggacatatcgatacggaccatcgcctcgtcgctatcaaacataaagttcgccagcgccttacaaagctctgttttccccacacccgttgggccgaggaacaggaatgaaccaatcgggcgatttggatccgccagccccgcacggctacgacgaatagcgttagataccgcatcaaccgcttcgttctgaccaataacgcgatggtgcagttcttgctccatacgcagcagtttttcgcgctcgctttccatcatgcgagaaaccggaattcccgtccaacgcgccagcacttcagcaatttcggcatcggtcactttattacgcaacagacgcatagttttgccttcgagctgcgttgcggcttccagttgcttttccagttccgggattttgccgtattgcagttcagacatccgcgccaggtcacccacacggcgagcctgttcaatagcgattttcgcctgttccagttccgctttaatggtctgcgtaccagaaagcgaggctttctctgctttccactcttcttctaactcggagtactgacgttctttgtcgctcagttcttcgttgagcatatccaggcgttttttactggcttcatcagactctttcattaacgcctgttgttccagtttgagctggatgatacgacgatcgagtcggtcgagttcttctggttttgagtcaatctgcatacgaatgctggatgctgcttcatcgatcaggtcgatggctttatccggcagctgacggtcagcaatgtagcgatgagacaacgtcgctgctgcaacaattgccgggtcagtaatttgcacatggtggtgcagctcgtaacgttctttcaggccacgcagaatagcaatggtatcttcaacagaaggctcggcaacaaacactttctggaaacgacgttccagcgcagcatctttttcgatgtactggcgatattcgtcaagcgtcgtggcacctacgcagtgcaattcaccacgcgccagtgcaggtttcagcatgtttccggcgtccattgcgccatcggctttacccgcgccgaccatggtatgtaattcgtcgataaacaggatgacgttgccttcctgtttagcaagatcgttaagtacgccttttaaacgttcttcaaactcaccgcgatatttcgccccagccaccagcgcgcccatatccagcgccagtacgcggcggcctttcaacccttcgggcacttcgccgttgataatacgctgcgccagaccttcaacgatagcagttttaccgacgccgggttcaccaatcaataccgggttatttttagtacgacgttgcagcacctgaatggtacggcgaatttcttcatcacgaccaatcaccggatcgagtttgccttgttcggctcgttcggtaaggtcgatggtatattttttcaaagcctgacgttggtcttcagcaccttgatcgttcacgctttcacctccacgcatttgttcaatcgcttgagtaatgttggcggtggtcgcccctgctgctttcaggatgtcggccagcgtgccgcgagactcaagtgccgccagaacgaacagttctgacgagataaagttatcaccacgtttttgcgccagcttgtcgcaaagattaagaacgcgcaccagatcctgtgatggctggacatcaccaccagtaccttcaacctgcggtaaacgatttaatgcctgattgatatctgtgcgcaactggccagcatttatgccagcggatgttaataaaggactaaccgaacccccttcctgattcagcagggcgctcattaaatgaagtggttcgatgaattggttgtcgtgcccgagtgcaagtgattgggcatcggcaagagcaagctggaatttattagtaagacgatccagacgcataactcctcccataacggatcaaagttgctactggagattaaatgaggtcatccctcaattattcaaggttattgaccagattaatgtgaaaagaaaatcacgcgtaccggatcgtcttgattctttaggttatatcagccaaatgaaacttgccatacgaccggtggtcttgtcgcgacgataagagaagaaagtctcattttccgtatatgtacaacggtcgccgccgaaaatttgttcaacaccaacgctcgccagacgctgccgggcaagctgataaatatccgccagatacttatcaccatgctgaatgaaagctgtactcgctttggcgtctactgccataaacgcctcgcgaacctccgcccccacttcaaacgcgtgtggaccaattgccggccctaaccaggcgagaatattttccggattatcagcaaaacaggaaaccgtctcttccagcacgcctgcgcacagtccacgccagccagcatgagcggcggcgacttccgttcccgttcgattgcaaaacagcacagggaggcaatcggcagtcatcactgcgcaaaccgtgccgggcgtattgctataagaggcatctgctcgttttgaggcataaggttcaccagtaagcttaagcacatctttgccgtgtacctgctcaagccagaccggtttagaaggcaaattgcccgcagcaaaaagtcgcttgcgattctcctcaacgtgatccgggttatcaccacaatgagcgccaaggttgagagagtcgtaaggcggcaagctcacgccgccgatacgggtagagctacaggccgcaacaccttttggcagcggccactgcgggacaatcagcttactcataaccagtccacttcatccttatgctcttcgaaatcggcgcgcatctcctcaatcagctccaccatatcttgtggaataggcgcatgccattccatttcgataccggagatcgggtgataaagacgcagcatggttgcatgaagcgcctggcggtcaaacttacgcagcgtggagataaacgcttccgaagcaccttttggcggacgcggacggccaccataaaccggatcgcccaccagcggatgagtgatatgggccatatgcacgcggatctggtgcgtacgtccagtttccagacgcaaccgcagacgcgtgtgcacacggaagtgttccatgatgcgatagtgagtgaccgccggtttacccatcggatgcaccgccatgtgagtacgtttggtcgggtggcggctgattggttcatctactgtaccgccagcggtcatatgaccaattgccaccgcttcatactcacgagtaatttcacgccgttgcaaagattcgactaaacgcgtctgagccggaacggtttttgccacaaccatcaggccggtggtgtctttatccagacgatggacgatgcccgcacgcggtacatcggcaatgggcggatagtaatgaagcaacgcattcagtaccgtaccatccgggttacccgcgccaggatgtaccaccaggtcgcgtggtttattaatgacgatgatatcttcatcttcatagacgatatccagcgggatatcctgcggttcaaaacgcgcttcttcttcaatctcagcgttgatggccacctgctcgccacccaatactttttctttcggcttatcacacactttgccgttaaccagcacgcgctggtcgaggatccattcttttattcgcgaacgtgaataatccgggaacatttcggccaaagcctgatctaagcgttgaccgagttggttttcggacaccgttgcagtgagctgtactcgttgtgccatatatactgcttcttcgtttatcgttggggttttacggctttgccgtttaatatagtgtgctattgtagctggtcttaaccgggagcaggaacagagaatctcccgtattacattttgaggaaagtcaaaacgtcatgacgcgcatgaaatatctggtggcagccgccacactaagcctgtttttggcgggttgctcggggtcaaaggaagaagtacctgataatccgccaaatgaaatttacgcgactgcacaacaaaagctgcaggacggtaactggagacaggcaataacgcaactggaagcgttagataatcgctatccgtttggtccgtattcgcagcaggtgcagctggatctcatctacgcctactataaaaacgccgatttgccgttagcacaggctgccatcgatcgttttattcgccttaacccgacccatccgaatatcgattatgtcatgtacatgcgtggcctgaccaatatggcgctggatgacagtgcgctgcaagggttctttggcgttgaccgtagcgatcgcgatcctcaacatgcacgagctgcgtttagtgacttttccaaactggtgcgcggctatccgaacagtcagtacaccaccgatgccaccaaacgtctggtattcctgaaagatcgtctggcgaaatatgaatactccgtggccgagtattatacagaacgtggtgcatgggttgctgtcgttaaccgcgtagaaggcatgttgcgcgactatccggatacccaagctacgcgtgatgcgctgccgctgatggaaaatgcataccgtcagatgcagatgaatgcgcaagctgaaaaagtagcgaaaatcatcgccgcaaacagcagcaatacataacagaaacctgaaacacaaaacggcagccttgagctgccgtttttttattctgttagttgtgaaactgaagcgatttagtcactatcgatctcatcaaatatggctcgctttgagatattcctcaagtaaaaaaacacctcttcctgcgatttctcacaaaaaagattcgttgacaaaaagtgacaaaattatgagatttccatcacacattttgacatcaggaacgttatgctgaattcaccaagacgggaagacaagaggtaaaatttatgacaatgaacattaccagcaaacaaatggaaattactccggccatccgccaacatgtcgcagaccgtctcgccaaactggaaaaatggcaaacacatctgattaatccacatatcattctgtccaaagagccacaagggtttgttgctgacgccacaatcaatacacctaacggcgttctggttgccagtggtaaacatgaagatatgtacaccgcaattaacgaattgatcaacaagctggaacggcagctcaataaactgcagcacaaaggcgaagcacgtcgtgccgcaacatcggtgaaagacgccaacttcgtcgaagaagttgaagaagagtagtcctttatattgagtgtatcgccaacgcgccttcgggcgcgttttttgttgacagcgtgaaaacagtacgggtactgtactaaagtcacttaaggaaacaaacatgaaacacacaccgtttttcttcgcattcttttttaccttcccctgaatgggaggcgtttcgtcgtgtgaaacagaatgcgaagacgaacaataaggcctcccaaatcggggggccttttttattgataacaaaaaggcaacactatgacatcggaaaacccgttactggcgctgcgagagaaaatcagcgcgctggatgaaaaattattagcattactggcagagcgacgcgaactggccgtcgaggtgggaaaagccaaactgctctcgcatcgcccggtacgtgatattgatcgtgaacgcgatttgctggaaagattaattacgctcggtaaagcgcaccatctggacgcccattacattactcgcctgttccagctcatcattgaagattccgtattaactcagcaggctttgctccagcaacatctcaataaaattaatccgcactcagcacgcatcgcttttctcggccccaaaggttcttattcccatcttgcagcgcgccagtatgctgctcgtcactttgagcaattcattgaaagtggctgcgccaaatttgccgatatttttaatcaggtggaaaccggccaggccgactatgccgtcgtaccgattgaaaataccagctccggtgccataaacgacgtttacgatctgctgcaacataccagtttgtcgattgttggcgagatgacgttaactatcgatcattgtttgttggtctccggcactactgatttatccaccatcaatacggtctacagccatccgcagccattccagcaatgcagcaaattccttaatcgttatccgcactggaagattgaatataccgaaagtacgtctgcggcaatggaaaaggttgcacaggcaaaatcaccgcatgttgctgcgttgggaagcgaagctggcggcactttgtacggtttgcaggtactggagcgtattgaagcgaatcagcgacaaaacttcacccgatttgtggtgttggcacgtaaagccattaacgtttctgaccaggttccggcgaaaacgacgttgttaatggcgaccggacaacaagctggtgcactggttgaagcgttgctggtactgcgcaaccacagtctgattatgacccgtctggaatcacgtccgattcacggtaatccgtgggaagagatgttttatctggatattcaggccaatcttgaatcagcggtaatgcaaaaatcattgaaagagttaggggaaatcacccgttcgatgaaggtattgggctgttacccaagtgagaacgtagtgcctgttgatccaacctgatgaaaaagtgccggatgatgtgaatcatccggcactggattattactggcgattgtcattcgcctgacgcaataacacgcggctttcactctgaaaacgctgtgcgtaatcgccgaaccagtgctccaccttgcggaaactgtcaataaacgcctgcttatcgccctgctccagcaactcaatcgcctcgccaaaacgcttatagtaacgtttgattaacgccagattacgctctgacgacataataatgtcggcataaagctgcggatcctgagcaaacagtcgcccgaccatcgccagctcaaggcggtaaatcggcgaagagagcgccagtagttgctcaagctgaacattttcttctgccaggtgcagcccataagcaaaagtagcaaagtggcgcagagcctgaataaacgccatattctgatcgtgctcgacagcgctaatacgatgcaaccgagcgccccagacctgaatttgctccagaaaccattggtatgcttccggcttacgtccatcacaccagaccacaacttgctttgccaggctaccgctgtccgggccgaacatcgggtgtaaccccagcaccgggccatcgtgcgccgccagcatggcctgtaatggtccatttttcaccgatgccagatcaaccagaatacaatctttcggtaaaggcggtaatttgccgataacttgctcagtaacgtggatgggcacactaacaatcaccattccggcatcggcaacaatatcagccgctcgatcccagtcatgttgctccagaatccgcacctgataacccgagagtgtcagcatcttctcgaacagacgtcccatctgaccgccaccaccgacgataaccaccgggcgcagtgacggacaaagcgttttaaatcctttgtcgttttcactggagtaagattcacgcatcacccgacgcaaaacatcctcaatcagatctggcggtacacccagagcttccgcctctgcacgacgcgaggccaacatagatgcctcgcgctccggaacataaataggcagtccaaagcggcttttcacctcgcccacttcagcaaccagttccagacgcttcgctaataaattcagcagcgctttatcgacttcatcaatttgatcgcgtaatgcggtcaattcagcaaccataataaacctcttaagccacgcgagccgtcagctgcccgttcagatcctgatgaatttcacgcagcaaggcatcggtcatttcccagctaatgcaggcatcggttacggatacaccgtatttcatttcactgcgcggttgctcggaagactgattgccctcgtggatattactttcgatcatcagaccaataattgagcgattgccatctttgatttgagcaaccacggattctgccaccgcaggctgacggcgataatctttattggaattaccgtggctgcaatctaccatcagagacgggcgcagtcccgcctgttccatctctttttcacattgcgcaacatccgcagggctatagtttggcgctttaccaccgcgcaggatcacatgcccgtccggattcccctgagtttgtagcaacgcaacctgccctgcctggttaatgccaacaaaacggtgcggctgggcggcggcacgcatagcgttaattgccgttgccagactgccatcggtgccgtttttaaaaccaaccggcatggaaagcccggaggccatttcacggtgagtttgcgattccgttgtacgagcaccaattgctgaccagctaaacagatcgcccaggtattgcgggctattcggatctaacgcttccgtcgccagtggcagtcccatattcaccagctcaagcagcaatttacgcgcgatctgcagcccggcttctacatcaaaagagccatccatatggggatcgttaattaaccctttccagccgacagtggtacggggtttttcaaaatagacgcgcattaccagatagaggctatcgctgacctctgcggcaagggctttaaatcgacgagcatattccagagcagtttccggatcatgaatggaacaaggaccacatactaccagcagacgaggatcgcgcccggcgataatatctgaaatggttttacgcgagtcagcaatctgggcttcttgttgcaggcttaatggaaaagcggccttcagttgttccggagtcattaaaacctgttcgtcggtaatatgtacgttattcagcgcgtctttctgcatgatggcgatcctgtttatgctcgtttgcgatagttgatcctcagcgaggatgacgtaacgataacacataaagtaaagttttcaatccatatttcgtacatatttctttacatgagcaatttattcgcgcttttttacccttgtctctgtatatataaatttacaccatctttaaaaacaatccgctatgctttgaaaaaggagaaagaaatgatgaaaaaatttatcgcccccttgttggctttactggttagcggatgtcagattgatccttatactcacgcgccaaccttgaccagcaccgactggtatgatgttggtatggaagatgcgatatcgggcagcgccattaaagatgacgatgcatttagcgattcacaggcggatcgcggtctataccttaaaggatatgccgaagggcaaaagaaaacttgccagaccgattttacttatgcccggggactttctggtaaaagctttcctgccagctgcaataatgttgaaaatgccagccaactgcatgaagtatggcgaaaaggggctgatgaaaatgccagcacaatacgattaaattaattacccccccaaaatcaattaagcatgagattttactcattatgttttatttctcacattgatgacgaccgcatgaaaggatgatattttaatgagcattctgaaaaaatatcgatgcatttcgagcgaagatggtgaggatccctgaatgcgtttttctcaccgactgttcttactgctgattctcctgctgacgggagcaccaatactcgctcaggaaccttctgacgttgcgaaaaacgtgcgtatgatggtttccggtattgtcagttacacccgctggcctgggctatcagggccaccaaagttatgtatcttttcatcttcacgttttagtaccgccttacaagaaaatgctgctacatctttaccttatctgcctgtcatcattcatactcaacaagaggcgataatttcaggctgcaatggtttttattttggcaacgagtcaccgacattccagatggaattaaccgaacaatatccgtcaaaggcgttattattaattgccgaacaaaataccgagtgcattattggtagcgccttttgtctgatcatccacaataatgacgtcagatttgccgtaaacctggatgccttatcgcgtagcggtgtaaaggtcaacccggatgtcttaatgctcgcacggaagaaaaatgatggataacgataattctcttcataagcgccccacgtttaaaagagcattacgcaacatcagcatgaccagcatatttatcactatgacgctgatctggctgctgctttccgtgacgtcagtgctaaccctgaaacaatacgcgcaaaaaaacctggcactgacagcagcaacaatgacttacagtctggaagcagctgtcgtttttgccgatggccctgcagcaactgaaacactggcagcgctgggccagcaaggccaattttcaactgcagaagtgcgtgataagcagcaaaatattctggcatcctggcattacacccataaggaaccaggcgatactttcagcaatttcataagccactggctcttccctgcccccatcattcagccgattcgccacaatggtgaaactattggcgaagtacgcttaactgctcgcgacagttcaatcagccattttatctggttttcgctcgctgtcctgaccggttgtattctgctggcatcaggcatcgcaattaccctcacccgccatttgcacaatggcctggtggaagcgctgaaaaatatcaccgatgtcgtacatgatgtgcgttctaaccgcaatttttcccgacgagtttcggaagaacgtatcgctgagtttcaccgcttcgctctcgacttcaacagtctgctggatgaaatggaagagtggcagcttcgtttacaggccaaaaatgcgcagcttctacgtaccgcgctacatgacccattaaccgggctggctaaccgcgcagcgtttcgtagcggcatcaacacgttgatgaacaattccgatgcccgaaaaacgtcggcgttactatttcttgatggcgataatttcaaatatatcaatgatacctggggtcatgcgacgggcgatagagtcttgattgaaatagcaaaacggttagctgaatttggcgggctgcgacataaagcataccgcctgggcggcgatgaattcgctatggtgctctatgatgtacagtcggaatctgaagtgcagcagatatgctcagcactgacacaaatttttaatctcccgtttgatcttcataatggccatcagactaccatgacattaagcattggttacgcgatgactattgagcacgcctctgcggaaaatttacaagagcttgccgatcacaatatgtatcaggccaaacaccagcgtgccgaaaagctggtgagataacaaggatatatcgatatgataaagcacctgctagcacccctgattttcacctcgctaatacttactggctgccagtcccctcagggaaagtttactcctgagcaagtcgccgctatgcaatcttatggatttactgaatccgccggcgactggtcgctgggcttatcagatgccattctgttcgcaaaaaatgactacaaattgctcccggaaagccagcaacaaatccaaaccatggcagccaaattggcctcgacagggctaacacatgcccgtatggatggacacaccgacaactatggtgaagacagttacaacgaagtcttatcattaaaacgggcgaatgtcgtggccgatgcatgggctatgggtggacaaattccgcgcagcaatctcaccacacagggtttaggaaaaaaatatcccatagccagtaacaagaccgcccagggccgcgccgagaaccgccgcgtcgcagtggtgattactgccccttaaaacacgagcaaacagacaaaaaaagggccagccaattggccagcccttcttaacaggatgtcgcttaagcgaaatcttagttaagacgctctttgatacgagcagccttaccagtacgctcacgcaggtagtacagtttagctttacgaacagcaccacgacgtttgacagaaatgctgtcaactaccggagagtgagtctggaagacacgctcaacgccttcgccgttggaaattttacgaacagtgaatgcagagtgcagaccgcggttacgaatagcgataaccacgccctcgaatgcctgcagacgttttttggaaccttcaacaacccatactttcacttccacggtatcacccggacggaaggaaggtacgtcctgcttcatctgctcttgttcaagttgcttaataatgttgctcataatttaatctcttatcctgggtaaactgatatctcgggggcttacgccatcccatcatgtttatgttgctgttgtgcgtgttccgttttgaactccgccagcaaccttgcttgctcttcagtcagagccaggttttccagaagttcaggtcttctaagccaggtacggcccagcgactgtttcaaacgccagcgacgtatctcggcatggttgcccgacagtaacactggcggaacttccatcccttctaacacctcaggccgcgtatagtgcgggcaatccagcaatccttcagcaaaggaatcttccgttgccgaggcttcatgtcccagtactcccggaataaaccgggaaacggagtcaatcagcgtcattgctggtaactcaccaccactgagaacgtaatcgccgattgaccattcttcgtcaatttcggtttggatcacgcgctcatctataccttcgtagcgaccacacaccagaatcaatttttgattcgttgccagttcgctgacgcccgcttgatcaagcttgcgtccctgtggtgacagataaatcacctttgcgccttcacccgccgcggcttttgctgcatgaatggcgtcccgcaagggttgcaccatcattaacatccccggtccgccgccgtaaggacgatcgtccacgatacggtgccggtcatgcgtgaagtcgcgaggactccagctctggatgctcagcaggccatttttaactgcccggccagttaccccgtaatcggtaattgcgcggaacatttcaggaaacaggctaattatgccaatccacatagcgccgtcttttaccgtttatccggtggtttaaaaaccaggatcccaatctacttcgattgaacgagtagtgagatcgactttcttgataacctgcccatcgaggaacggtacgagacgttccttgataccaaacgcatctttcaggtttgccttaatgacgagaacgtcattagatccggtttccatcatatctacgactttaccgagatcgtagccttcagtggttactacctggcagcccatcaggtctttccagtagtagtccccctcttcaagctgaggcaactgcgatgaatccacgacaatttcacaattcgtcagcaggttcgccgcatcacgatcgtcaacgcctttcagcttgatgatcatgtcctgattgtggtgcttccagctttccagctggacttgctgccactgacccgccttctggataaaccagggctgatagtcaaaaatgctttcggcgtcttcggtggaagaaaacactctgagccacccacgaataccgtaagacgaccccatttttcccaaaacgatgggatcaacaggtgcttgcgcggtgagttgtttgctcatcatgaccaccgtgacagattaagctgctttgtttacttctttgatcagcgcagcaacgcgatcagaaatagttgcgccctggccaacccagtgagcgatgcgatccagatccaggcgagtgccttcttctttttcgctagcgattgggttgaagaaaccaacgcgctcgatgaagcgaccgttgcgtgcattacggctgtcagcgacaacaacctggtagaacggacgctttttagcgccgtgacgtgctaaacgaatagttaccataacatcctcttgtgtgaataaaacaaccggaccccatcgaggaacggagtccggtgtcatattaaaagcccgaaaattttactgatttctggagaaaatgcaatcagcagttaataactctatcgcataaggtcatttagcgaccaggaaatcccggcggcatcatccctttcatgcttctcatcatcttcgccatcccgccctttttcattttcttcatcatgcgctgcatgtcgtcgaactgtttcagaagacggttaacgtcctgcacctgcataccgcaaccggcagcgatacggcgtttacgcgaacctttgatgatttctggcttagcgcgctctttcatcgtcatcgagttgatgatggcttccatacgcaccagcactttatcgtccatctgcgacttgacgttatccgggatctgccccatgcccggcaacttgcccatcaggctagccatgccgcccatatttttcatctggcgcagctgctcaagaaagtcgttgagatcgaagccgtcgccttttttcagcttgctggctaatttctctgcctgcgcgcggtcaaccttgctttcgatatcttcgatcagcgacagcacgtcgcccatgccaagaatacgggaggcaatacggtccggatggaatggctccagcgcctcggttttctcgccaacaccgaggaacttgatcggtttgccagtgatgtgacgaatagagagcgccgcaccgccgcgggcatcgccgtccactttggtcaacactacaccggtaagcggtaacgcttcattgaatgcttttgccgtattggccgcatcctgaccggtcatggcatcgaccacaaacagggtttcaaccggattaatcgacgcatggacttgtttgatctcgtccatcatcgcttcgtcaacgtgcagacgaccggcagtatccaccagcagcacgtcgtagaatttcagtttggcttctttcagcgccgcgttaacgatatctaccggcttctgaccaacatcagaagggaagaaatcaacgcccacctgctctgccagcgtctcaagctgtttgattgccgccgggcgatagacgtcggcagaaaccaccagtactttcttcttgtgcttctcgcgcaggaacttaccgagtttaccaacgctggttgttttaccggcaccttgcaggcccgccatcagcacgaccgcaggcggttgcgcagccaggttcagggtctggttctcttcgcccatcgccgcaaccagttcgttacggacaattttgacgaactcctgccccggcgtcaggctcttattaacttcatgaccaaccgctttctcttttacgcgattgataaactcacgcactaccggcagagcgacgtccgcctccagcagcgccatgcgcacttcgcgcagcgtatcttttacgttgtcttcagtgaggcgtccacggccactgatattgcgcagcgtgcgcgacaaacgatcggttaaattatcaaacattgtctctcgcctggggtggaaacggttggccgcaatcgcgacacatcatcagtattttgccgcagtataacatgaaggcgtctttgttgttatgcaacggttggagcagcgttcacctgacgctatactgcttctctttcttattgctcaaactgtcgacattactatgcccgtttttgctctgctcgcgcttgtcgcctactccgtcagtcttgcgctgattgttcccggtctgctgcaaaaaaacggcggctggcggcgcatggctattatttctgcggtcatcgcgctggtctgccacgcaatcgctctggaagcccgcatcctgcccgacggtgatagcggacaaaacctcagcctgctgaacgttggttcattggtcagtttgatgatctgtacggtaatgaccattgtggcttctcgcaatcgtggctggttgttgctacccattgtctatgcctttgcgcttatcaacctggcgctggcgacctttatgcccaatgaatacatcacccatctggaagcaacgccggggatgctggtgcacattggcttatcgcttttttcctatgccacgctaattatcgctgccctgtacgcgctgcaactggcgtggattgattaccaactgaagaacaagaagctggcgtttaaccaggaaatgcctccattgatgagtatcgagcgtaaaatgttccatatcacgcagattggcgtggtgctgctaacgctcactctttgcactggcctgttctacatgcacaacttatttagcatggaaaatatcgacaaggccgtgctctctatcgtggcgtggtttgtctatattgtgctgctgtggggacattatcatgaaggatggcgtggacgccgcgtcgtctggtttaacgttgcgggtgcagtcattctgacactggcctacttcggcagccgaattgtccagcagttaatcagctaaccccagaaaaggagtttcccctggaacacatttctactactacgttgatcattattctgatcatcatggtggtcatttcagcctatttttccgggtccgaaaccggaatgatgactctcaaccgctatcgtcttcgacatatggcgaaacagggtaatcgctcggccaaacgcgtcgaaaaattgctgcgtaagccagaccgcctgataagcctggtgttaatcggcaataacctggtcaatattcttgcctccgcgctcggcactattgttgggatgcgtttgtacggcgatgcgggcgtggcaattgcaactggtgtgctgacttttgtcgtactggtttttgctgaggtattgccgaaaacaattgccgcgctgtacccggaaaaagtcgcttatccgagtagttttctactggctccgctgcaaattttgatgatgccgctggtctggttgctgaatgctattacccgcatgttaatgcgcatgatgggcatcaaaaccgatatcgtggttagcggctctttaagcaaagaagagttgcgtaccatcgtgcacgaatcacgctcacaaatttcccgtcgcaatcaggatatgctgctgtcggtgctcgatctggaaaagatgaccgtcgatgacatcatggtgccgcgcagtgaaattatcggtattgatatcaacgatgactggaaatcgattctgcgccaactctcccactcacctcacgggcgcatcgtgctctaccgtgattcgctggacgacgccatcagtatgctgcgtgtgcgtgaagcctggcgactcatgtcggagaaaaaagagttcaccaaagaaaccatgctacgcgccgcggacgagatctattttgtcccggagggtacgccgctcagcacacagttggtgaagtttcagcgcaacaaaaagaaagtcggcctggtcgtcaacgagtatggagacattcagggactggtgacggtcgaagatattctcgaagagattgtcggcgatttcaccacgtcgatgtcgccaacacttgccgaagaggtcacgccgcaaaacgacgggtcggtgattatcgatggcaccgccaacgtgcgagaaattaacaaagcctttaactggcatctaccggaagatgatgctcgtactgttaacggcgtcattctggaagcgctggaggagatcccggtagcaggcacccgcgtgcgtataggcgagtacgatatcgatattctcgacgtacaggacaatatgattaagcaggtaaaagtttttcctgtaaaaccgctgcgcgagagtgtggcggagtaacgaaaacggcccggcattcgcatgctgggccgtgatttattacgaaagcagaaattaatcttttgctttcgctacagtaaccatcgccgcacgaatcgtacgaccgttcagcgtataacctttctgcataatgcccagtacgttacctggcgcaacgtcatcagattccaccattgcgatggcctgatgcacatttgggtccagtgggacgttggtttcggcgatcacttcaacgccaaacttacgcacaacatccagcatcgacttcagcgtcagctcaataccttcaaccatcgcggacatatccgggttagctttatcagccacttccagcgcccgatccaggctatcaatcaccggcagcaattcgttgatgaatttctccagcgcgaatttgtgagctttttcaatatccagttcagtacgacgacgcaggttttccatttcggcttttacgcgcaaaatgccgtcacgttcacgggtctgggcttcagccagctgagcttcgagattcgcaattttttcatcgcgcggatccacctgctcagcagaagcttctggctcaactgcctcaatctcttcgtgctgatccatgataatttcttccggggcttgcccctcaggcgttttctgttctttactactcatgaatttctccgcgtttttttcgcattcatctcgctaacttcgcttattatggggatcagtttcagggtttcaagggaagcactcacattgtcatcaatcttcgcaacaaggacctcggaaaaatgaataatcatttcaagtgtattggcattgtgggacacccacggcaccccactgcactgacaacacatgaaatgctctaccgctggctgtgcacaaaaggttacgaggtcatcgttgagcaacaaatcgctcacgaactgcaactgaagaatgtgaaaactggcacgctcgcggagattgggcaacaggctgatctcgcggttgtcgttggcggcgacggtaatatgctgggcgcggcgcgcacgctcgcgcgctatgatattaaagttattggaatcaaccgtggcaacctgggtttcctgactgaccttgatcccgataacgcccagcaacaattagccgatgtgctggaaggccactacatcagcgagaaacgttttttgctggaagcgcaagtctgtcagcaagattgccagaaacgcatcagcacggcgattaacgaagtggtacttcaccctggcaaagtggcgcatatgattgagttcgaagtgtatatcgacgagatctttgcgttttcgcagcgttccgatggactgattatttcgacgccaacaggctccaccgcatattccctctctgcgggcggtcctattctgacaccctctctggatgcgattaccctggtgcccatgttcccgcatacgttgtcagcacgaccactggtcataaacagcagcagcacgatccgtctacgtttttcgcatcgccgtaacgacctggaaatcagttgcgacagccagatagcactgccgattcaggaaggtgaagatgtcctgattcgtcgctgtgattaccatctgaatctgattcatccgaaagattacagttatttcaatacattaagcaccaagctcggctggtcaaaaaaattattctaattttacgccagcctctttactgtatataaaaccagtttatactgtacacaataacagtaatggtttttcatacaggaaaacaactatgttggcacaactgaccatcagcaactttgctatcgttcgtgagcttgagattgattttcatagcggcatgaccgtaataactggcgagaccggcgcgggtaaatctattgcaatagatgccctcggcctttgtctcggtggtcgcgctgaagccgacatggtgcgtaccggcgctgctcgtgccgacctgtgcgcccgtttttctctgaaagatacgccagcggccctgcgttggctggaagaaaaccagcttgaagacgggcatgaatgtttgcttcgtcgcgtaatcagcagcgatggtcgctcccgtggtttcatcaacggtacagctgttcctctgtcacaactgcgcgaactgggtcagttgctgattcagatccatggtcagcacgctcatcagttactcaccaaacccgagcaccaaaaattcctgcttgatggctatgccaatgaaacctctcagctccaggaaatgaccgcacgttatcatttgtggcatcaaagctgccgtgacctcgcgcatcatcaacagttaagtcaggaacgcgccgctcgtgcggagctgctgcaataccaattaaaagaacttaacgaatttaatccgcagcctggagagtttgagcaaatcgacgaagagtacaaacgtctggcgaacagcggtcaattgctgaccaccagccagaatgcattggcattaatggctgacggtgaagacgcaaacctgcaaagtcaactttacacggctaaacaactggtgagcgaattgattggcatggacagcaaactgtccggcgtacttgatatgctggaagaggctaccatccagattgctgaagccagtgatgaactgcgccactactgcgatcgtctggatctcgatcccaaccgactgtttgaacttgaacagcgcatctcaaaacagatttcgctggcacgtaaacatcacgtcagccctgaggcattgccacagtattaccagtcgctactggaagaacagcagcaactggacgatcaggccgactcacaagaaacgctcgcgctggcggtaacgaaacatcatcagcaggcactggaaacggcgcgcgcgttacaccagcaacgccagcattatgcaaatgagttggcacagctgatcaccgatagtatgcatgcactctctatgccacatgggcagtttacgatcgatgttaaatttgacgagcatcacctgggcgctgacggcgctgatcgtattgagtttcgggtaaccaccaacccaggtcagccaatgcagcctattgccaaagtcgcatccggtggtgagttgtcccgcatcgcattggcaatccaggtcattaccgcgcgtaaaatggaaaccccggcactgatttttgatgaagtggatgtagggattagcggcccaacagcggcagttgtcggcaaactgctacgtcaacttggcgaatcaactcaggtgatgtgtgttacccacctgccacaagtcgcgggatgtggtcatcaacactattttgtcagcaaagaaaccgatggtgcgatgacagaaacgcatatgcaatccctggataaaaaagcgcggttacaagagttggcgcgcctgcttggtggcagtgaagtcacacgtaacacactggcgaatgcgaaagaactgcttgcggcgtaaacttttttcctgcttcacggtcagagtaaacagcaaaacgccgtaagaccggaaagcaaaaggttttaaagtgatgaaaggtctattatcatcggcatattacagatgagccacgtactgctcgggcccgaaaaggaatcaaatcactatgcgctgtaaaacgctgactgctgcagcagcagtactattgatgttgaccgcaggctgttccactctggagcgagtggtttaccgtcctgacatcaaccaggggaactatctgaccgctaacgacgtatccaaaatacgtgttggcatgacgcaacaacaagttgcgtacgcattgggtacaccgctgatgtccgatccatttggtacaaatacctggttctatgtcttccgccagcaacctggtcatgaaggtgtaacgcagcaaacgctgacgctgacctttaacagtagcggtgtgttgaccaacattgataacaaacctgcgctgagtggtaactaataataaagttgctctcaaagacgttaaaaaaggtgctcaatgagcaccttttttctgtctgttatttattcgctgatttttctgctcgttgcctgcgaagctctttcggatcggcaatgagaggacgataaatctccacccgatcgccatcatgcacaatatcgctgagttttgccggatggctgtaaatgccgactttgtttttagttaaatcgatatcggtacgcaattccagcaaaccactggcgcgaatagcttcttcaaccgtcgcgccctcctgcaacgtcacgcgctgcaggtactgcttctcaggtagcgcataagccacctcaacggcaattttacctggcactgtagacctcttttgcacgaacagtaaaagcctgcaccatattatctgccagctctttaaacacacgaccaaaggcgagttcaatcaacttattggtaaactcaaagtcgagatgaaactcaatacggcacgcgtcctggctcaacggcgtaaacttccaaccgccgatcaatttcttaaacggtccatcaaccagactcatgagaatactttgattactggtcaactggttgcgggttgtaaacgttttgctgatcccagccttagacacatctaccgcagcagtcatcagcccaggagtggactccagaatccgacttccggtacaacccggcaaaaactgaggataagactgaacgtcattcactaactgatacatttgctccgcgctgtagggcaccagtgcggtccggctaatctgaggcataacaatttccatcaacaaaaatccaacaaataatatcatttatcctgctgtaaaaaaaacgctatcccggcgctgggtaacatcgggttcatgctaagatagagccttgtcccccgcaggattgatatggggtgttttcgatttcagattaccgatgattcacgacgcttatgacgaagaaaaaagcacataaacctggttcagcgaccatcgcgcttaacaagcgcgcccgtcacgaatactttatcgaagaagagttcgaagcgggacttgccctgcaaggctgggaggttaaatccctgcgcgcaggaaaagccaatatcagcgacagctatgtccttctgcgcgacggagaggcatttctgtttggcgctaacatcacgccaatggctgtggcctccacgcatgtggtgtgcgatcctacccgtacccgcaagttacttctcaaccagcgcgaactggactcattgtacggtcgcgtcaatcgagaaggctataccgtagtggcgctctccctgtactggaaaaatgcctggtgcaaagtgaaaatcggcgtcgccaaaggtaagaaacagcacgataaacgttcagatatcaaagaacgcgaatggcaggtggataaagcgcgtatcatgaaaaacgcccaccgttaaacctatataagcgatactaatcaaatcctcaccgcgcctccctatccggtggcgcgaatgaacatcttatcgactgtcaaatctgacacagatgtagccatcccattgcttaatcgaaaaaaaatcatactatgcaggcgctaattccaggatgataacgccttttgggctagtcatgctgctcataaatctggtatacttaccgttacacattggggctgattctggattcgacgggatttgcgaaacccaaggtgcatgccgaggggcggttggcctcgtaaaaagccgcaaaaaatagtcgcaaacgacgaaaactacgctttagcagcttaataacctgcttagagccctctctccctagcctccgctcttaggacggggatcaagagaggtcaaacccaaaagagatcgcgtggaagccctgcctggggttgaagcgttaaaacttaatcaggctagtttgttagtggcgtgtccgtccgcagctggcaagcgaatgtaaagactgactaagcatgtagtaccgaggatgtaggaatttcggacgcgggttcaactcccgccagctccaccaaataaatcaaggggttacgtgaaagcgtagcccctttttctttggtagtggcggcaaaatggcgacagacttttgcgtccatcttgcctgtcgccatcttgaaatcatgcaaagaggtttcacatggaagaacttcactttgtttacatcaatgcaaatggtcgtatcggtgttcactctatacagagcatcagttatagcgaaaatcatatacagggcatttgtaagaacaccgatcgaataaaaaccttccgaaaagaccgcattcttaaacagtacgattcaccagaacaagccattcaggagtgcgcgtcattcctccccgaaaactactcacatctcaccaagcagtctggtccgaaaaaaaatacattcgatgtatgtttcaccggatttaagaaagcagataaagaaagattggttgataaggcgaatgaacaaggattaacggtaagaacctctgtaacccaaagccttcagatgctctgttgcggttacaatgcaggcccatcaaaagtatcggcagcccggatgaaaggcacaatcatcatagatgagcctggctttatacattttcttgaaacgggtgagatcccagatgaataaaaacctgccgtagcaggttctctttctcaaaaattcatatgcccctgaccacctggcaatggatgtggaggagcagtagcaatcagtgcgggtgtcacaataaaccggaccactgtttcatgggtaacaaaagtgctcccgcagttaatattttggcactggcagtaacgctctttggtgctttcagttacttgaaaactgctccttgtgtgtgccgcatgaccacactttggacaattcatcatatccagatccctacctttgctatcagaatcattgtaatgatacacaaaatatcaatattgagaacactttattccatttcaagatcatcaatcttcacttcgagttcaatactggttgtaaaaccgttatccgggctgacggtatgtgtcagagtcgtaatggtccattccgcatcatctatcggctgtttaaaaccactgaccttcacaggcatttccgtgtagagatctgcccgcccttccgccagttgtagcgagaatgacgcaacgccacgttgcaggcgttcccactgcattttcgctgcccgttcagcgttgctccggttggcataagtgcgattaagtaccagcacgttttcatccgtccccaccaggtaatcgccctgcttcgcttccggctctttcttctgcttcttagtcctgcgcttacgcttcaccgtagtgctttctttcttcgcgggttcgcgggtatgcaaccagctggcaattacccccgtgtaagctccgcgatctgccagggtaaagcggtgactgtcgccgtccttacgtgtgatagtaatcaccggcagtggtttaccgctggcgcttttgccctgtccctgccggatgaataacagattgccatttttcaccgatgcaatggcaccgtactggcgcgccagccgcatcaaaaaactgccgtcactctcattagtctggtctatatgctccacaggcttatccgacaggtctttacccagtgccatcttcagcttgtgccgcgcggctatttccttcaccacttccccgatggtggtgttatgccacgatttttcacggcgggtattcagcgtttcccgaaaatcagcacttcgcgcccggatagtcaggcggtccggtgcgccagtgtgttcaatctcgtccaccgtgaatgcccctttcgggaaaagcggctgccccttccagcccagcgccagcgtaatgaccgcaccacggcgcggcagcacgatttttccgtcggcgtcgtccagctccagatcaagctggtccgcttcaaagccccggttatccgtcagcgtaagccccatcaggcgtttgtccagcacagtggtgatatccttcccctcaatactgatgctgaatgcgggagttttgttgcctttgttaagcagttcagagctgaaattcacgacagcagccctcccaccgttttactgatatcgcttaaggcagacgttgccgtatcctgcaaattattcagctgcgcactgagatcaccgaacatatcggacagggattcatccacccgtttgagcgacagggtaaactcaatccggcgcggcataccatcgcggaaaaactccgttttagtctgattcagtccctcaatcacatacatgccgtaaatcgtgccgctgccttcaatcaggggccatgcttttccctgttctgccatctgctccagagccagcaacgacagcctgccgcccgttatctccggcataagaacaccagaaagcgtcagcatgtcgttgtccggtcccagaaactgcgtggacggacgacggtttacccggctgtttgccgcatgtcgccagctgcgttgatactgcagttcctgatacggaacggtgcgcagcataaacacgtacaatcccagcaccatcatcatgcgtcgtatcccccctgatcgctgtagttactcctggcttttgccttcagcctgcgttcacgttcatcaagctggcgtgccacctcccgcgcaatatcctgcgcactttgtcctggctgcgtctgaatgatgatctgcgtcggtgcctcaatccggtgaacgggcggcacagtggctgcacgactcaccatcgcttcgccgcctttcgcgggaagtgccaaaggatgcaacggtggaagctctgcaggcgcggcagcaacgcccatcattccggcaacaacggcagccagtgcagctgtatttctccggctggtcacatttgccgggccgttaacaatttccggcccgttttcaccgacgatgccaaactgcccacgcgggatatagccgccgctgtcatacatccccgcaaagccatatccccatgacggaaaaccccccgatggcatcatcactttaccgtctgcattcaccgtcgcaggttgctgacgcgtcactctttccggcagtttcgcctttgcagcctctttactgacaatgccgagtttctccagcaaccaggaaacgccggatttcagggagtccagcggatgcatgaccatattcagcccttccgccagtgcctccccgaatcgccgccccattgccgctgcactctgcagttcggcagaggtcgacttaacgggcgtcagcagatcagtaaaccagccccacagcgcctgtactttgtcgccaatccactggaacacgggcttaagcggttcgaatgctgcactgacgggacctgccgccgctttgaatccttccaccacgccaccaagaaatgcggtgatgggttgccagtatttccagacaaccagcgccacgcccgccagtgcagtaaccacaagacctatcggactgagcagagcacctaacagaccagatacggcatacagggcaacgcgcagcatcgccagtggaccagatgccagtactcgcagcaccgtgcctgcggaggccagtccaccgcgcagtaccgccagaggattcataaacatcacagcaacagcacgtaaaccggataatccagaccgcaaaagtgcaaccggcgcacctgctacagttttcaggacatttcccgtcagtgatgccgtgcggcgcaaagacgacaacggcgcagtaagtaaacctgcggcgttgcccgatgaagcaagcccgcgtcgcagcagtgcaagtggtgcgccagccaaccaggacaacgcgctgctggttcgcgttactgctgccgtaacggaaggtaacgttttgatacccagcacagagaatcccagacggatgactgccagcggccccagcacagcagccaacaccacagccagggtgccgaggcccacagtaacagcagccacaaccgcggctactttcatcagtgtgcccgtcagttcagggttagcttccacccagcgacgcaacgcccccgtgatgcttttcaccgtgtacagaatatccatcagcggctggcgcagcgtttcgcccaggctgctgaaggtgttctgcgctccggttttgaccaacaaccactgcgcagaaagtgagtccttgttaatgtcggattctttctgcatcgaaccgagcgcatcattgcccgctgtcagttttagctggcgctgcagttccggcaggttgtttgccagtttcgccgcatcatcgccaaactctttaccaaacaacatggtcatggcagacaggcgcttatcctgcggcagtgcgttcaccttctccagtacgcgctggatagttcccatcgcatccttcgtcatctgcttttcaatcacttcaggattgagtttcagcagattcattccttcaaagaaactcttgctttgcatggtcgcaatggacaattcacgcaccatcgcgttggcagcactggcagcgacctccggcgcagcacccagtgtcaggaaggtggaacccagcgccgccgctttacgataatccagacgatcagccacaccgcccaggcgttgcatgacatcaatgatgtctgcccctttcgacatagcgttatcatccagatagttcagcgcatcaccgagctgttcaatattgcgggttggtattttgtagagctgggcgattttccccagactttctgacagttcatcagctggcagctcaaaggctgttgccgcctttgctgccgtactggcgaaggccagcaggtcacgtttctggtcctcccagctgtcgtcagggtttgccacattcatgcgcgcaccaccttcaaccagtgcggcgaagtccacagcaccgttttccattggcagctgttcactggcagctttgatggcatcctgcatttcgtaaaaacgcgcagtgcggttgccattatcgtcacgcagaccattgacctgctttgccacacctttcatggcatcttccatgctggtatagctttttaccgccgccatcactggcgcgcccattgccagccctgcagccgtggtggtggctccggctcctgcgatgcgatcgcgcacttcaagccgtcttgagtattgttctctggcagcgttcatccgtgcctgttgttcacccagacgtttaagtgcttttttctggccctccagtgcctgacgagtttcttcggcatttttcttaagttctcgctgggcactactgagttgtctggtatcaatccctgattctttaagtgcctgacgttgtctctggaccgcccccaacaagccgttataggtctgctgaagttcctgtactcgtgttttggcctgactgaataactttgcctgcgcggcggttggcctgttagtggcagcaaattgtgtggcgagttttgccgcctcttcgcgggctgcgttcaggttgttggctgttatggctagttgcgagcgcgtcttgcgaaattcatcaattctgccagcctgcttattcagttctttgaggctgtttcgggtattctgaattgcgccagccagctctttcgaactggcctgtgcagcacggaatgggcgggtgagtttgtcaaccgcattaagaatgacctgcaggcgcaggttattatcactcatcgttggccccgcttctctgaatcgctttataccgccattccagcacttcggtcagcggcataacgtcagtaacggatggcggccagtgaaagatggtggcgatatcagccaccagatcgtcaaccgtcaggctgtcggtaaaccggcaagcaccgacttcttcaacaaaaaagtgacaacctcaaccgacatggcagtgagatctgccgggtccatctctgcaatttcctgtgcagtcagtgccggactggagatgcgggggatcacggtcatcatcgcgttcacatccatatccataatggcctgcaggcgtgtaccgcgcagcgcaccggactgcggtttacgcagcacaatttcggtgatttctgttttaccgcgcttgatgggggtatccagttgaatagtcttttcagtctgcttatcgctcattttgctgtcctgtaaattgggttctggcgcggtatcccgcgccgttcagatacatcagaggccgagggcgttgcggtgcgcttccatcaggtccacaccgtccacaatttccaccatgttgataaggtccacttcatagagcacctcaccatttatagtcagcttcgcgtagctgttggtactggtcactttggtggtgttgctttcgcccgtcttccactcgccggaatccacttctttgtgacgtccacgcaccacaagctccacggcctgcacttccccggtatcgtcacgctggatagagccggtaaagcgcaactggataccatccaccgtggctttgcccatctgcttaaacagcagcagttcagtaccaccaatggaaaattccgtatccagtgcgccgtcatccagccccagatccacatccactgcacccggcattccgccgccgcgatacttctcatatttgcgggtaaatttcggcagcgtcagcgactcaacgatcccctgccagttgttcccgtcattaaacaggttcaggtgttttaatttgcgtggtaaagccatgttgtccccttacgcgctgacctggctggagaaattaaccaggtactgatcggtgatgcgctgacgcagcatcaggttttcaagtggcggcactggcgtgtagtcgtagtcgatggtgagttttccggctttcagcgtgtctttgtcgttcaccgactcatccagccagcaatcaccaccaatgagatagccctgactgaccaggctgcgcattttggcgcggataccctcgataatgtcgcgggccagcgacggattcagcggtttatccaccgcccacatgtgcgcttctgccatcgtgtccgtcagcacctgcgccgtgcgggtgtagttttcgaaggcaaagagcgggtcatcactcaggcagcgggaaccccagaagcgaaaaccgtctttgcggataagggtggtgacgtcgttctggttcagcagtcccgcatcggttgccgggtcctgcagatcccagaacacatcagcagaaattccggtgacaccgttaacgcccacgttggacaggcttttgtgccatccggtctgctcgtcaattttggcgcgcagaccaagcgcacgggcggtggcataagccgttgcttcggcattcagcaccgtgtcccagccagtaaagtcgggccagatcagcattccttcacgctgactgaagttttcacggtaagtgattgcttcctgcaccgtcttgcaaccatacgctgacaggtaagcaaatccacgcaggctttgcgccacactcagcaactcagtagctaccgccttcgtgtcgtgacctggcacgccgagaatgcgcggtttaacgccgagctgtgactgggcagataacagggctttcatgcctgtttttttaccttcagcggtcactgcgccgatgatattggtcgtggtttcttcttccgtttcaccctgcggcacacgcacaacaacggtcacgggttttgcctggtcagcgatggcatccagcgaacgagccagcgtgcctgactcacccgctttaccgctggcagtcagcacatcagtgatcagcacgggtttattaagaggaaacatttttgcatcggcatcatcgcccgtgcagaccatacccacgatggcggtgctcaccgtggtaatggatcgggtgccttcgttgacttcaacaacgcgcaccccgtggtggtaatcctgagccatagtggcgaacctcctgattggattaggcttcgccctatgttgaagtgattgtgcctgacaaacagctaagcgcagttgtaccgttattcacacaaaatgacggtatttgtctgctttcagggataatcaaaataaagctgattcagggagatttattgttcttatttgccggaaattttcgataaatggtagaaacgcctacatcaaaaatcagtgcaatacgctgtcttgattctccgtcctcgagtaaacgcccaatctgtgcccactgttcgctggtcaacttaggacggcgtccacctactctgcctttagcacgagctgcagccagccccgccctggtacgttcaactatcagttcgcgttccatttcagccagggcacccatgacatgaaaaaagaaacggcccattggggtgctggtatcaatactgtcagtcaggcttcggaaattcacgccacgctggcgcagctcttctatcagcgtaacaagatgccgcatactgcgccccagtctgtccagcttccagacaaccagcgtgtctcctgccgatagtgtcctgagcagctttttcagccccggtctgtcggacttggtgccactgattttatcctcaaaaatccgctcacatcccgcacagttcagtgcattgcgttgcaaatcggtgttctggtcatttgttgacacgcgtacatagccaataagcatgatcatccccctgaataaaaaccggagatgatgccagttagccgttatctctgcattttcataaacgttggtttgggagaaggctctgcattaccggttggggtgcctgttccgtggccttcagccacaccgccgacaggctggctgaaatgcaacggtgcagctttttctgctgaagaatacccggaactggcaaaggcttatccgacaaataaattgcctgatttacgtggtgagtttattcgtggctgggatgatgaacgtggtgtggatagtgggcgaactctgctttcagcgcaaggagatgctattcgaaacattactggcggttttggtcagttgcgcgtaaacagcgaaataaatgcaattgttgatgttcaaagtgtgagtggtgctttttacggaggtacctcagtccggaataacatcaacgtatctatgacatacgctaatgaccgaaaaatccgacaagatgttcacttctcggcggcaaatgttgttccaacagcaaatgaaaatcgtccacgtaacatcgcctttaattatattgtgagggccgcatgatgaataaagctgtattaaatagcgaactcatcaccacaaaggcgggagacattaccgtttacaattatgatggtgagacacgagaatatatttccacatcaactgaatatcttgctgtgggtgtcggtatcccggcatgttcctgtttagatgctcctggaacacataaggctggttatgcaatctgccgttcggcagatttaaactcatgggaatatgtgccagaccatcgcggtgaagttgtctataacaccgaaacgggagaatcaaaagaaatcacagctccgggtaattaccctgaaaatacaaccactatcgtcccgttaacgccatacgataaatgggatggtgagaaatgggtgacggataccgaggcacagcatagcgccgcagtagaagcggcagaagcacagcgccagtcgctgattgatgctgcaatggcttccatcagtctgattcaactgaaattacaggccgggcggaagctgacgcaggcagaaaccacccgacttaacgccgtgctggattacattgacgcggtgacggcaacagataccagcactgcgccggatgtcatctggcctgaactgccggaggcgtaggccattcaatatctggagcactggaggtatcaaccagttccagtgcgtccagataatccagccacaaattatattgcgccagttcctcacctttcagacgaccaatagcggctttaccaggccattgcttactgttcatgtattcgttggcctgttcaataagtatacttttcattccctccgcttcagctatttcctgttcctgtgtcttcgctggatattcagtaagtacagggtagttatccgggttattgataataattttccccgtactctgaccattcataagttcataataaagagcatcttcaatatcgaaagtatcatcgggaatatcgctgttattttcagagaaaaatccctgaacagatggggaccatttcattttcataatttcccaattcctaaaatgtggacatcatcagccttacgggcattccaggtgacaattacatcggtagagtgacgattaactgagattgcatatgcttcgttagtcgagccagaaacttttgtagcaaacacagcaaacaggacaccaaatgactggggccatttatagcctgacagctgataattaccattattcagtgttacagctttggctgctgcacttgatggaatcgtcagccactgaagtatcaaccctcctggcaaaagttgttttccgtaataatccctcaccccactaaatgaagccatgtccggtatctgattttcccctgttcccacaccccgttttgccgcttctcccaaaccaaggtatgcgagaagaccagctacatcctttccactcaaattagtcagcgtattgtccagcggttgtttacctgctagcgcattaagcattgtcgtggcaaagttcgggtcattccccagcgccgccgccagttcgttcaatgtatccagtgccgcaggtgcagaacccaccattcctgcaatcgccgatttcacaaaagccgtagtggcaatctgtgtattgttgaccgactgcgccgcagtaggtgctgttggcgttccggtaagtgccggactcgacagcggcgctttcagtgccagcgcattattaatagtggtactgaatttcgggtcattgttaatggctgcggcaatttctttcagtgtgtccagcgtggctggcgcaccgttaatcagagcagtaatagcggcctgaacaaactctgtggtcgcaatccgagtggtgttatttcctgctgcaggcgtcggcgcttttggttctccggtaaatgtcggattatgtttctgcgcatactgggtatgaggatcttgtgcggcaatgtggtttctcatctggtcatccacatacagctttaattccaggactttatcatccacgtatttacgggttgccagcactacagcagggtcgattttcaggatgatattgtccgtgctgctggtaatcagcaccatgcgcacggtctgggtacgcccgctgccttcagccagttgcggcttatagctttccgggcagtttcccacggcaatcaatgccccggactcatcaaacaggcccacttcacgtatccaccaaccgccctcgttttcagggatcacctgttcagcaataatctggctactgttctgcgggtcgatataaagcatattcaacgcagcccggcgtttctcatttaccagtgccgtctgctttgcgtccggcgtcggtaatactccgccgccatcgccgaccgccatatgggtaatttttagcggcacaccgagcgcggcggcgctggcaagtttcgccgcgccaatatccgtcagcagggtataaaattttgtgctcatggattcactctcattgtgtcaataacatggaccgccccgccttcatgcgcggtgccgccagaaataattgtttcgttgatatacggatagatcgtgatttcttcaccaagatagctggcggcccctacccagtgcgggccactggtctgcagattgatggacatgccgatcatgtgacggctacatggtttggcatcgcttatcagccgctcaagttccagataggtatcttcagtgatgccctgatcctgcacgccgatatccaggcgaaacgtgcctggtatttctccggtctgccaccactcaataatgcggatcaggaagccgaacggctccaccacccgccgcacggcactggtggttcctttgtgctgatgaatataaaaagcatccttcaccacctggcgtttgacgctttctgtccagctctcgtcccagcgatccacagagaacgcccaggcgagataaggcaggaaactgaccggacaggtcgcaggattccacaagtcacgcagtggcacctgcagatcagaaatcccgctgcaggttcgcgccagtcggcgctccagtggtgttgaacccggtggcagcagactattcatccgttcctccgttggttacgctccactgcgtacatgatgccgcctgtgttttgttcaggaccacatccgccagcggcgaagccagctccacacgctgcaccccctcaacatgcagggcggcaaagatggcgctacggcgaatatcccgaccaagccgcgtctgactggcgatgtacttctgcaggctggcttttgccgcggccattaccggctctgcttccggtcccggataaagaaaaatggtggcttccacgcgatacgggatgatttctgcgctgcgaaccgtcagacggtcagccaccgggcggacgttctcactgttcagggcgttctccaccacatccagcaagtctttttctgctgttccgtcgccttcgcggctaaggacagtcagcaccacctctgcaggtgccggactggttgcactggcatccgccacccgaccgtcggcgcttcgtgcatgaaactcataagcggcagttggccccgcaacagaaagcccctcaaaggctgcaggcacacgcaggcgtaacgcttcatcgctttccatcacagctgcaacgggcggcacagcgtcattatcagcaggcgtcaccgtcaggcgtttcacgttgtagttggcagcgagctggtcaagatcgccgcccatcgcgtaagccaccatcacagcctgcgcggcttcgttaatgcgctggcgcagaagcaactcacggtaagcgttctcctgaagcaatttggtgacgggttcagattccagttccagcgtgcggatcacggcttcctgctcatctttcggatgaagcgcaacaaattcggccttgcgttcggcaagcagcgcctcaaagtccggcacatcgacaatctgcggcgcaggcaactgcgaaaggtcaatcactgccattctctgctcctgttgatacggaaagggacacaggcacaccgttattccgccgcccggtcagctccaccaccatagaaccgtcaaagttgctgttgatggtgatggaatccagcgtcagccgtggctcccagcgactcagcgccacatacactgccgacatgacctgcaggcgtaacgccggattttgtggctggtctatcagtgccgacagcagggaaccatattcacgacgagcaatgcggctaccctgcggcgtcagcagaatgtcccgcaccgactggcgcagatggtcaatatcagtaatgactttgccgctggtattgttcatcccgctataaagcgtcataccggtcctccggttgtatcgccgcctttcaggacgccagtatgctgatgcgcatcaaccacgatcccgttagaactcatcgctccgccgccctgggtaacaccaccattgatcaccacttcgctgttaatgcgcgtgcggtcagcctccagtacaaactcactggttttcatggtgatgttgtcagcggcctcaatgaccattgatttgatgcccctgacataccagcgcccggtggcgggttcgtattcaaaccagccaccgtcaggatgttctgtcacgcaggcgtctgccgacgtcgacggtggtgcgaactgattcgaatagacagcgggcagcgcaaaggcagtttccagattgccgcccaaactcagtagcaccacctgctcaccttccgatggtttccaccatgtgcgggcattacccgcgcgcagcgtcagccagttaatccagttggtttcaaggtcgcccgttttcacccgacaaagccagtgttcccggtccacttcggtgactacaccagtgcggatcagattggtgataaggcgcatgatttcggttaattgtgcgttcatagggaaaggttgccatcaggggaagaaaggcggcagtgctgcaacttgtatcactgctgatacaaaaatcaccccgccaaccattgcagaatcatgtcgcgggtcattgcctcaacatcatcatttacgcccagaaggcgacgctctgcgtaacggacctccggtcctttgcggctgacgcgatcacgcaggccataatggtgaacgcgggcaatgcgctgcaccttaccttcaaactgcacgctggcagaatcctcgctggcggcggttttcaggtattttgtggtgcgaagttttgtaaacatctgccgtttgatacggccttttttactgcgtgctgttactcgcctcggttcatagctgctgccatcaggattgcgttgcatcctgatgttctgctgctgtgtccggcgcagttcctgcgccagctggcgcatcatgcggcttctggcggctggttccagattcgccagcaaggcactcagccagtcgtccactttctgcagttcagccacgtttcaccgtccacatttcttcaggttcatcaggttccgctatagcttcaacgctcgacacactaccgtcagtgctgaccagcacacgctccgtcagttgcaggttcaggctgatatcacagacatcgttgcgcagaatatccacctcaaaggtgaatagtttttcccgtaacgccgggttattgatggcatcgggctggttatccctcagccacagcaaaaccggggccatcagcagattctggtcgccgctgaaatcctcaatcaccgcattcagggtgtaacggtactcccacgacatggagctggcccccgtggcaaccagcgaaccgttatccacaaacagatgcagtttgtccgggttattgcggacataaggcaccgctttattgagggcgtggcgcagggattgtggtttgttcactgtttcgctcctgacacgcaataatcatatccactttgtctgcacagaccgcccaggcggcctccgtttcatccagcaacgcattcagatcaccgttagtgcgcggcgctgcctgatccagccgacacggcgtcactcgcggacaaccactgacggtaagctgcacctccggtgagtgtggggcgttcccgcagccggataatgtcagcaggcaaaggagtatcagcccagcggcgtaaatcctcgttctcacgtttcagttcctcgatccggtgttgtcgttgtctcagcagcgcgctggtctgttctgcttcggcatagagccgcgcctgctcccggttattggtttcagtcagaatagacaggctgataagctggctgttgctctttgccagtgcctggcttttgctctgcagctcgtctgcctgcgtgctgatggtctggctggcatcagccagccgccacgtctgccagcccagcgccgccagtaataacgccagcacaaccagcagtaaccggttcatgctgctacccgttgcgccatctgattacgggtgatccagaaggcaataacggtcagtagataaaagaccagggtaatagcccaccccgtccaggcgagacttacaacaatcagcaatcgcatcacccaactggtaaatacgttttcttttcgggtaattgtcttcagcaaagatgccctcaactcctgccagagcgggccattcttaattaacgcaaccagtgctaccggaattaccgcccatgtcagcaaacaggctacccaaacgccggacgctgccagtaccggaaaaatcccctgcggatacaccattgctgcgattaacagcgccatccataacatcagaaacagtccgctgattaatttctttttcatttcagtttgctccctgtaaacaccaggccatctcccgcgcacggcggttatccagcccctgattaaacacaccttttacataaacccagcgcggcaactgtcggcacgcatccgcccagcgccgctgattgagcaatttcaccagcgtggagctgcaggcattgcccgtccccacgttgaaggcaaacgacaccgtagcgtcatacaccttctgtggtggctgttgcttcacacacctttccagtgcccgctccacacgcagcacgttggagatcagcccttctgctgcctgtcgttccgtgattgttttgccgggaatgacgcccgatgtattaccaatgccgtcggtccagacacccgcgctgcactgatacggctgcagacgacagccttcgtaatcggcaatcagtttcagcccctccacggaggtgtgaagctgctgaaaacccggcagcgtggcagcaatagccagcacggccccgacaaggcagcgtttaacgattgatggattcatagtcctcccgcgagatctgcccgtcgcgcagaagctggtaggctttgtgtttgtagtaccagttgatagccagcatcagcacaccaatcatcaggccgcccagcgttgaggcatccttgatggacaaatcgcccagccaggccagcacgacggcgatgcaatacgtgataaaggcgctgattcgctcaagcgtcataattcagtcccatagctggacggtctgcacggtggtggtggtcggaatgtccggcagctccacctgcagcccgtgaggtaaaaaggggccgtattcggcaagccccggatttgccttcagtacctgctccgtgacaccctgcgtgcgcccgtaatgacgccagcaaagcgcgtccaccgtgtcatactgatgcgcacgcactttcatcagataagctccactgtgcagtgcggcgcatcctgcacccggctgatggcccagcgggcgtcacgccacaaatcaccgcttgcttccgccagttcctcgccccgcttcacaccggacgccgtggcgtcatagtcctggtaacgttcgttgagcatggcgcgtgcccagcagtaaaccgcgttgaaatagtgctgaatgcgctcacttttgccgtccagctgttccgccggaacctctgccagcgaggcataccccagcatctgctggcgtctgcgaaactcatacagctctgcgttgacctccgaaattgccgatagcgcaacctgctttaaacgcggctgcgtcaccgtgccgtcagtgcgcatcacgctgcgaaactccgacaggtccacatcaggccagaacggcgtattcctgatgatttccgcctgttccggtgcctgttctggcgcaacaaacttcatgctgctttctcctgaaatagagggcggtggacggggttttgatgtggcagtgcctttcgccaccccgtgccgcccgtgcgcgggggcacgttctgtcagcggctgtcattgcgcagtctgcgctccagctgctgtttgtcttttttcacgccacagcggggatcgagctgtaacgcatggttgagatgattaagggcggacgccggattgctttcactcaggacagcgccaatcgctttatgcagacgcgcccgtgactggtccggcatatccagaccgtctgtcagttccagcgtctgcagtaatagatccgcatcaaagccggtggcggcaagcattgcgctctgcgccgcgtctgacatttcctctgccagcacggtctgcacgttgcggttacccagcggcatcacccagccatgacgcagagcatgacgcccgatctccagcgccccggcataatctccggcatcaatgcgccacagcatcacgtacatcagcacgtcatcctgttgagcgcctccggcagccaggacgccctccgcccaggcggcatatttcggcagtagctccaccttgatttccgcttttttcaccgtggactgaacgcccttgagacggcggcggtcttccgccagttgcagcagcatcaggtcatagcccgatgcgtggcgaacactgccgccctcgcgggcggcctgttcagcctgaacgcgcaggcgatgctgccgtgcgggactcaggctcatggattacgctccggtttcggctgcggcggcgctgaaatcaccaatctggatgttttccaccagtgcggcacagcggtagtcctcaaccacataggcttcgttaacggattcaaagttttcaatccggtcacgtttcgggttgtcgataactgaacggcggcgggtgtcttcctgccagtagatggacaggttatccagacgggtgatcagcagcgcattcggcgggaagaacggcgcacgcacggcctgcaggccacccatgcgtttctgactgatgatcatatcggcagccagtttttcactgttttcctgctctttgttgaccagcgggaaatacttgtcagacagcagttcacgaccgcaaatcaccaccagatcgtcatcgtcctggtagaccacgtcgataagctcattgacggcatccatcaccacggcgtccaggttggcatattcgccacctttcccgactttcactgcgcccggtgtggtttcaccgcccgtggtggtgctgcccatgacgtgatccggtgcatcctcacggattttctgcagccagcctttattcacatcctgcagtagcgggttttcgctacggttagaggttttcgcacgcttcacgccgttaaagccgatcatgatgcggtccagtgcctgacgtttcacgatggcgttacggatacgcacctggaaatcctgaaacttcgcccacaggtccagcttcgcgtaggtcagcaccgtgtcaaagttggtctgttcgcatttgtattccacatcgaccatcagcgtcggatcgacaggttcacgctctttcgcggtggtgtcagtggttccggcaatggtgctgccaacacccagccccagcagctgaccggactgctcagtcactggcgtgacgttaatcagcgtcaggaaagcggcggactgctggatctggtcttccagcgtctgctgcacagacggctccacagtgaacttgctggacagttcttcaactgccacaccgttcagacgcgccagctgctgcaggtaagcgttaaaagcaaagcgggtattcttcttcatcgggttttatgctccatcagcaattggtcagagtgtcagcaggggcgttaccgcctgttgcacgctggcggtagtcctggcggcagtcctcatggctcagcttgtccaccagttcgttaaaggcggcctgttgtgcctgcagggcagtctccaacttagacaggcgttcttcctgctcagacagggatttttcggtgcgtgcgctcaggttttgctgctcagtggcgaccagctccacggccttatgcacatcagagaaccgggcatcgtcggactgctcttttttggtgaacagcgccgtgacgcgggcaaacagggacggcttgtcctcctggatttcttccagttcgatcaccgtttcctctgcggcggtaaagagattggcgggattctgcttgcggtttgccagcgggttatgggctgcactggcgctgaatgtcagcatttccgtacccagactggctggatcatcagtggcggccaggccaaccaggtaggctttgcccgtatcagcgaacttcgggctgacttccatagaggtgaataatttctggccttttttcaccagttccaccagggactccgttggctcaacgtcggcatacagtgccatcttgcccgccagcgggccttccgtgatttcttcagcaaacagcgccgtcaccttgccgtagcggttaaaggtgctgtccggcagataagacttgatgtgctcaaggttaatcagcgcggtgtacaccgccgggttgtagctggctgccatctgttccagccattcacgctggatttcgcgtccgtcggtggtggcaccttccaccccgatgcgaaaacgctttgctttcactgtcatgagccgtgctccgttagaaaaaacttactggagccttatggttgcggtgatgggggcagtgaaacaatgcgcggtatttgtaccgactaccacacaaaccgcaggcggggaaagccttcattcaaggctgtaggtttgtgccatgaacaccacactgacacccgcagatctcgatccccgtcggcaggccatgctgctgtactttcagggataccgtgtagcccgcattgctgaaatgctgggcgagaaagttgcaaccgttcacagctggaagaaacgcgacaagtggggtgactatgggccgctggatcagatgcagctcaccaccgccgcacgctactgccagctcattatgaaggagcacaaagaagggaaagatttcaaagagattgacctgctggcgcgccagtcggaacgccacgcgcggatcggcaagtttaacaatggcggcaacgaagccgacttaccccctaacgtcgccaaccgcaacaaaggcccgcgccgtcagccggaaaagaatgttttcaccgatgagcagattgagaagctggaagaaatcttccattcctccatgttcaactaccagcgccactggtgggaagccggaaaaaccaaccgcatccgcaacctgctgaagtcacgccagatcggcgcgaccttttactttgcccgtgaagccctgattgacgctctgcttaccggacgtaaccagattttcctttccgccagcaaggcacaggcccacgtctttaagcagtacatcatcgacttcgccaaagaagtggaagtggagctgaaaggcgatccgatggtgcttcccaacggggccacactgtatttcctcggcaccaatgcccgcacggcccagagttaccacggcaacctgtatctggatgaatatttctggataccgaaattccaggagctgcgcaaagtggcttccggtatggctattcacaaaaaatggcgacaaacctatttttccacgccatccagcctgacacacagtgcttatccgttctggtccggtgcgctattcaaccgtgggcgcaataaagccgacaaggtggacatcgacctgtcccacagcaatctggctccaggcctgctgtgtgcagacgggcaataccgccagatagtcaccgtggaagatgcggtgcgcggcggctgtaacctgttcgaccttgaccagttgcgcatggaatacagcccggacgaataccagaacctgctgatgtgtgaattcgtggacgatctcgcgtccgtatttccgctcagcgagctgcaggcatgcatggtggacagttgggaagtctggaccgactttcatgcactggccctgcgcccgtttggctggcgagaagtgtggatcggttatgacccggcaaaaggtacgcagaacggcgacagcgccggatgcgtggtggtggcaccgccagccgtgccaggcggtaagtttcgcattcttgagcgtcaccagtggcgcgggatggacttccgcgcccaggctgacgccatcaaaaaactgaccgaacagtacaacgtgacctatatcggtatcgactcgacaggtgtcggtcacggagtttacgagaacgtgaaagcgttctttcctgccgtccgggagtttgtctacaaccccaacgttaaaaatgccctggtactcaaggcctacgacattatcagccaccgccgtctggagtttgacgccgggcacaccgacattgcgcagtcattcatggcaatccgtcgtgccaccaccgccagtggcaaccgcccgacctatgaagccagccgcagcgaagaagccagccacgccgatctggcctgggcaacaatgcacgcactgtttaacgaaccgctgcagggcgagtccgccaataccagcaatattgtggagattttttgatgggaaagagtaagaaaaaccgcgctgcggcgacgaatcagatccagcataaaaaccagacttcagccgaagcattcagcttcggtgatcccgttccagtacttgaccgccgcgaactgctggactatgtggaatgtgttcagacagatcgctggtatgagcctcccgtcagctttgacggactggcgcgcaccttccgcgctgccgtgcatcacagttccccgattgcagtaaagtgcaacattctgaccagtacctatatccctcatccgctgctcagccaacaggctttttcgcgttttgtgcaggactatctggtatttggtaacgcctacctggagaaacgcacgaaccgattcggtgaagttatcgcccttgagcctgcgctggcaaaatacacccgacgcgggttagacctggatacctactggtttgtgcaatacggtatgacaacccagccgtatcagttcacgaaaggcagcatttttcatctgatggaaccggacatcaaccaggagatctacggcctgcccggctatctttctgccattccatccgccctgctcaacgaatccgccacgctgttccgccgtaagtattacatcaacggtagtcatgcaggcttcatcatgtacatgaccgacgccgcgcagaatcaggaggatgtgaacaacctccgcaacgcgatgaaaagcgccaaaggtccaggcaacttccgcaatctgtttatgtactcgcctaacggcaaaaaggacggacttcagattatcccgttgtcagaagtcgcagcgaaggatgaatttcttaacatcaagaacgtgagtcgggatgacatgatggcagcgcaccgcgtgccgccgcaaatgatggggattatgccgaataatgttggggggtttggggatgtcgaaaaggcgagtcatgtatttgttcgtaacgagttaattccattacaaaaaaggctaattgaattaaatgaatggcttaatgacgaaattattcgttttgacgaatataaattaggcaatacttgattaaagcctgtttaaactggctgtcggaacagccagtttaaacaccggcaccaatgaaatcgccatatgaatcttcttcaaggctgatgtattctaccctccattgatccatccgcctcaatgcatacagggagaaatgagtatcagcaacagctatgcacgtattcaattctataagttctgaatgccccaaggttggatcaccataaaacttataaaacaaagcctttagatcagaacatgtttgttcagccgctcttctggcatcggggccaccttcagttgcatcataaacaacattgatagaaagctcatatggtatgccttcctcaagatcgttaaatctttcttcgcccaaatcgaaaaaaactccgatcaaatgctctgcgtttgtggcgataatatccgcaacttctttttcgaaaataaactttttatcctcgtcgtaagcccgcaagcgctcttcaaacgagttaggaaacgctggacgaccatacttagcagctaaccattgcttaagagcttgtttctcttctgtgctaatggagaatgctggatcgttttcctcacaacagaaagcttctttaggaatgatgactttcctttcatgccggagctctactgcattcttcttcgcactttctgggttttcaaaacatagatcgagtattctcggatgcttagctcttttcatcctgcttgacccctttttcaaggggccaaacatcagttccacgtttttttctgaattactctgtaaatcacaatcatgcgttataactacaactttatggttcgtttcatcaggctgcagaattccaagtgaaacggcatcatcatgtttaagtacatgcccctgacgccatgatgttcctcgtaccaacataaatgtgatttattcctctaccgttccaggaattgaaatagatgacttccaatcatctgtcggtttcgccttgcttgctaagtaattggccgattcagcagcagcattcatcgctttagcttcatcaatcaatacctgaactgccctattccaatcctcaccttcttttactacgtccattaatgacttaccattaaatgctttcattttcaccaatagcttcgcatcatggagtccagctttggaaaaagagtcagcgacattactaaggttggtaatgaattgcacttttgaagcatcatcaggctggttctcccctgacaaccatttatagagagcctgccgagttatccccaaatcctttgccagttctgacattgatggagacagcacttctcgaatattagctaaatgttgggcaacattcctgacatcaacctcaggagaaattgcaggcgtgtacgttgattctatggaatcaaatgcaaactgaacccttggctgaacatactgacgccattgcttataagcatttacagggtatgaagcccccgtaccaactaatagtaaagatgcggcgacagcaacaacacctgatacacatgagcttgactgcaaatttggagaatatcgatctacagagcctatgcttccggtgggaattgcatacattttagtcacctccgttgtttcagtgccatttagtacgggcaaaatctgaaaccatgccttcaaatgcttctttaactttactatgcaacgaaagaatctgtttttcaattaactgcaaatcagttgacatgttgccttcaacataatgatctgtatcaattattgcgtgcatacgatgctctgtgttactaaatctcggcaacggcagtaaaccattaggaatcatatctggcggaaaacctagctgaccattcatcttatgtattcgtgaaaccataaatccattagggatcaatggctcaacacatgtctgatatacggactcttgtatagactgtattggcgtccatccgaaatcaacaccatgaagttcctttacaagatactgctcaattgtttcgcttttctcaggaaacacagcatccaaatatcgaagcccaatccgacttaacagcgatggcttagcaaattctagaactttgctcagaccaagtatcaatgacgagatgaaagatacatggttatcataatatgttgtatggaacgtaatgaaatcgttgcctaaaacaaaaccagatcttctatctgcatcaatcatcaaccaacttgtcacaggctcaaatgaatgtaccggtggctcattggggttttttatttcaaatttcaactgagttgtattggaaacctcaaataaaggaaatccctcaactcttagcgcatcttgtatgtctggaacatacttactcattgcagctattggagtaaactttacctgtaccaatgcatagtaaacgggcgcattggacatacgttcgctgttagtactcatgccgccctccttgaaattgtttcatctcatatctctttatcttactaactgtagtttacacataggttgacactttctccatcattaagttcactatgacatcaatagccaaaactcttacgtaatcgcttcggcgcgcgctcgtatccccgccacgcctgcccgctttatgtagtggttttcatgcacctgcatgatctacgcaaaagcccaccagttctggcgggccttagcaaaaacgatcctcaaacgatcatgcgatctcatgcggcatagacatgcactacagagctaacgcctcgcaagggctcgttgttcaaccttgctgacgccagaaacaagttcagacgccagcaacgtttcttaatgcagccagctgtcgtcttcccacaccttctgcataattttcatcacttgcttcctttcttcgtccagttgcagtccggtcagttccacaccgttagagctacctttgcggatacgaattaccgttttgggatacagggggcgcagattacggtaaagctcggattcaagggcgtccagggtagactggctaatcttctgctctttatcgatcattatttcaatgcgcataaaagtcacctcagctgatgacatccattgagcggttgtattcgtggcttctgatttttgccatgagttcatcagtcaattcagaaacccactgcagagccagtcccttctcttcatcactacactcactggccgctacaagcttaagaaaaaaatcaatgcgctggagcttcaaagactccaaaaaatagtcctgcatctttcctcctatgacaccacacgcaatactgtatgtataaccactgtttataattacagtatataataatcttactgatgtaaaacgtttttttacgtttatcagcctgatatgcctggtattattaagagcacgaatggttaaccatcgtaattaatacaggtttcgccacttatcatcttcctgcaaacgctggttccgatagaagatacgcaggcctgctcctgacgaaatactgccgccgcgaaggagtaaatcgacctctttctcgctaccatcaaaccctctggacttcagctcatacacgagctgctgtcgctgatggtctgtaattcgctgtttgtagtctttacaccgtttcggtttaaccaggtgtaaccttgctgccagttcccggcgttcttttttgctcatactgtgcaggtaatcgtgcaactccttgtcatccatgcgggtgatatccgttctggtatccccatcagctgatttgtctttcccttgttggttcaaattttcagcaaggggacagttattgccacgagtccaaggggacagttattgccacgagtccaaggggcgcaagcgccctggtcggctgccgcctcctgaacgtcaacggccttacgaaccattttccacttcacggcatgagtgcagattttgccctctgcaatgggtgaccagatgccataaatacgaatgccgtgatcgccataggcggtcggctcttcgttgatttcataagcggttctgatgaggtgatatttacggggaaccagtacgccgccctgcttcatgatgtaggtggcaaaacaaccagcatcagctgcagccagaatggcatcaaggcgcgggttatccagtaccggcgcacctgcttttttgtcaccctgttgccttgccgcctgaccagccagcaatcgcagttcacggtaagcctgacgccccggaatgccaaagaagcggaattgctgaacacgatgcagagacgcccaggcattaacgtattcagcgttatcacgcagagatttacccgtttccttgctgatctcgccagccagaccacgcccgtcaatgttcttactgatgtatttcgcgatgtagctagtcggcgttcctttgcgcgggtttatcagctcagacttaaagcgtggccccgtgttattacccagctcctcgcggtcttcacggatagcaaacttacgcaacaatgcagtaatggcgcggcggtcttttttgcgcatgaaacacaacaggtgccagtgaactgtgccgtcatgatgcggctcagccacccgcacgccataccagcgcaacccggctttgtgcatcgccttacgaaatgcagcaaacatgccgaccagataatcactgctttgtcttaccgtcgcatttgtccaagtcgggttgggcctaccgttatttagcgtggaatggaaacgtgacggacaggtgatggtgtagaaaacggcgcagtcaccgcgcatttccgcgataagctccagacctttaacacaggccatcatctcattgcggcgatgcgcagggttgctgctgctggcgtttaccacatcctccatgtccagcgtgtcgccgtcttcgttcaccagttcatgagaacggaaaaactccagcgacttacggcgctgctcacgtttatgcatcacggcttcatagctgacatagggagatgcttttttgctgaccaggcaaacagcacgcaactgctcttcccgccattcgcaacgcatcttccacaatttccgataccaccagtcggcgcacagcatacgcgccagcgaccccggaatgagttcatagggcacgggtttacggcggtttcttttccggcggagttgctcaaacgcaggcggtatgacatccagtcgcagggtttccgccgccaccttttcccatgtcttgcggatttcttctggcttaacgtcatcggtggcatacaaatcgccacaagcggcatcaaggcacatgctcatatgcgcagctaccagggtggacaggcgtttcacctgatcctgactcatttcaggcaggatcagcagaccgtccagcccttcatggcttgccataaagcgaaaagaagtggatagctgactgtcgcgtacatgctccagtcgttccagacatggcttaatcgtctcacgcaaatagcgggaataagcctttggcctgcccaggctgctgaagtattcaatacgttgcatcagcggcttgctgatatgggaaggctgggcgttaacgtccgccagaatgaccatgcccggattaaaacgctgctgctcatgcgccagctttgcccggctaatgagcttatcctgctccatttcgcgctggacaggatcacgtgattcattaaagaaataacgctcccatacctgatcactcagagcctcgcggcgcagttgttcctgctcgttatcggtagcgtacagagtgatcaggtttgaaagcgcagaaaccggcgcaacttccgccgggtccagataagggttaatggcctttttcgggctgttccatgagaatgctgcggcgacctcgttaaagccgctgcagttgttcatatcagcatggctcatgcacgcactccgtacacggcagaactatccacgccacgcgaaggatcaaatcccacccagcagcgcggcccggaaacagcgatgatttctgttgcagatttactctcaccagctgctacaccgatgctgcgttttgccttgatgtagtggtgagtaaaattgcgatacagcgaacggatcagggatgtatcactgttagaaacaatgaccggatgtccttctgatgaccgatgttcaagaacggatgccaggtgatactggtcatcttcagtgaaaccatcagtgtgatagccggaaaacgtaccgtcatacggcggatcgcaatacaccacatcccccacctgcagcatcgccagcgtttcatcaaagcttgcgcagataaacgttgctcgctgggctttttctgcaaatgtgcgaagttctttttcagggaaatacggatttttataattaccgtagggaatgttgaaatgcccgctcttgttatagcgacataaaccacggtaaccgtgacgattgagatacaggaaatataccgctttcatgaaatcagtaatttcagtggagtaattaaactcctgccttatgttgtaataagccacctccctgtttgcgatctcaaataaaactctggcgcgagatataaacgattcacaatcagcggcaacctttttatagaggttgattaaatcaggattaatatccgcaaccagatagctggggtaatccgtctccatcatcacagcacaagaacccgcgaaaggttcaaccagtcgcgggcctgcaggaaggtgttttttcagttcggacataatggcggttttattacccgcccatttcaggatggtgctcatacagcacctcctgcaataacatatcctaaagcttctaatggggttaatgagcgaattgatagcatcacccattgttctgaaactgccatgacgtcattaaccggaagcacatgagagataaccgcggcccattccctacccgtaaatacgccatgcttccggtaatgactccaacttactgatagtgttttatgttcagataatgcccgatgaccttgtcatgcagctccaccgattttgagaacgacagtgacttccgtcccagccttgccagatgttgtctcagattcagattatgtcgctcaatgcgctgagtgtaacgcttgctgataacgtgcagctttcccttcaggcgtgattcatacagcggccagccatccgtcatccataccacgacctcaaaggccgacagcaggctcagaagacgctccagtgtggccagagtgcgttcaccgaagacgtgcgccacaacagtcctccgtatcctgtcatacgcgtaaaacagccagcgctgacgtgatttagcaccgacgtagccccactgttcgtccatttcagcgcagacaatcacatcactgcccggttgtatgcgcgaggttaccgactgcggcctgagttttttaagtgacgtaaaaccgtgttgaggccaacgcccataatgcgtgcactggcgcgacatccgacgccattcatggccatatcaatgattttctggtgcgtaccgggctgagaggcggtgtaagtgaactgtagttgccatgttttacggcaatgagagcagagatagcgctgatgtccggcagtgcttttgccgttacgcaccacgccttcagtagcggagcaggaaggacatctgatggaaatggaagccacgcaagcaccttaaaatcaccatcatacactaaatcagtaagttggcagcattacccatgcttccattcgcaaagagaaagaacatcaccaactttatagccacgatcgtctttacgaagttcagccgtcttttgacctgcaaccacagcgttgaaatacttaggtgcaatttttaattgatggatacgcacagcccctgtcatacagcacctccgttgtaatgtttgcctttcagctctgcgatttcctggcaagtaatgcaaagctgcacacccggaatggcgcggcgtcgtgctggcggaattggcgcttcacactcaatgcaaagcacgcgagacacgcccggtgttttggcacgagcagcacggatatggcgctggcgttcttcttcaacgcgctgctgtacgagatccattgcatcagccattagtggatctcctgcgcttcgttctggattgcttcagcagtcacacgcagcagttctgccgcttccacgtggtttagctgacgggatgagatatgacacgccaggctatcaaggcgagctgccattgcttcagcccttgcccggcgttcttccagacgagcctctgtcagtaaaatattaagccctgcatcatccggtccggttttagtcgtaaggatttcaatattacgcataatcaattctcctgaatttagataaagggatgcccggcgggtttacgccattaatttcattagttggttaattcggcatggttagccgtttgggaaataagctcaccactgcacgaaaatgattcattgctttaatcaactcccgcttttcgtcagtggtcagctcattaatgctgatgctatgacgttcagctggaatttttgccataaagaatatggcagccagtgctcgtttattttgttcgttattgatatcccgtggatcacgcatatctttaataaaccgctcaagctctgactcaatattcaggccaaatactttcgcccttaactccgcaatgtgattaagtccattcaggcgttcaccggggcttaatggaacagtcgccgcagcgccattaattgccataattcatatccccaaaacgcaactatcgttctttgttcttacggtaacgttcaagaggagatacattttttcgtatcgtctctttaacctgctctccccgtaaaaacgtcccatcccttagcgtgaaaaagtaactgccatcgcccgacaacgacggataacaacagagcaaatcatcttcaggtactgaataactctcccctctgtaacgaaactgataaaccacttcactttccgctgcatacattttgactttctccgtttcctcgtggtcaattcagacagcaattcatcttgtgaatgacatggatgccagcgtttaccatcctcacccatgatccagccgtgaccgtagtgcattgccgggctttgttttaccagcagcgatgcaaatgatggttctttcgtcagcataagcacctcacagcaaaccgaatgaagcaccgaggccagtcacggtatcaactgcactcaccatcgcaggattagcctgtaaacgggcctgcaatgaaacagccgccagcgccatcagtcgtgttacagagttaatgctgctgatagcatcacgacgaccggcactagtttttacatcaccagataccgcacctgctgcaacacgcccgatctctgcagttgcgctcatgacgtaatgcggcagtttctcttttgccacctcattaatcggtacacatggcagacaatgaatctgtgccagaaaaccatctaccagcgttgaatcttcagtcagatcggtaagcagccagatttctggtgcggttaataaatgaggctgagctgggttcagcttgttccgcagaatctgcacattcatgcctgcacgttctgccagttgcaccaggttgtgacgcagtgcaaaagccctacaggcttcatcgaaatgcggatgtttggaaatcttgtaatcaaacatggtgcccccttagaaagttcccataattgaacttacttaccaacaatgacgcggaagttggaatgaccgagggattcacggacctgatcagttttgtacatcagataacgaaggcttacgcggcctttatttttttctttcttgaccatgtacttagcaagttgaccatggtgaattttttggtaaacagagccacgggaaatgccctcccactctgcgaactctgcaggcgtagccatctcttttggtacacgaattgaaatatcagtactcatagtgcagtatctcttactttgtgtgcgtgttagttcgttttagctcgtctctttaactctcacatcaagagacacgaagacattacgatcttgattcaagattgtcaaatggagattaccaatgttaaacatcagaatgggttccgatacgggaggtaaggcagctattgagaggctgcttgaggcttatggattcacaactaagcaggcattaagcgagcacctgaatgtctcaaaaagtactatggcaaacagagtgttacgtgacagttttcctgctgactggataattcagtgtgcactagaaaccggtgtttcgttactttggttagccactggacagggaagcatgaaagaaggatacgagcctgagaaaagatctcataacgagaacaaacaagcaattaaaccgttatccaaactcataactccatctattcctaaaggaaccttggaaaatggacaactcagtattgatgaagagattttcctagaccacagcatattacctgcagattatgaagaatcgatgttcttagaaacccctactgattgttatctcatcgataaatcagttaaacaagtcagcaatggattctggcttatcaatattgatggaatgattattattgcaaaaatcatgcggattcccggcaataagattgtagtaaatcaagatgaagcgtctttcgagtgctctgctgatgatgtggaagttattgggcgtgcagtcaaagtaataaagagtatctaaacatgactgtcagaaaacagccaaacggtaaatggttgtgcgagtgctatcccaatggacgcaatggcaagcgcgtgcgtaagcaatttgctacgaaaggcgaagccattgcttttgaaagcttcacaatggaagaagtgaacaaaaaaccatggctgggggaaaaggaagatcggcgacacctatcagaattaattgagcagtggtattccctgtatggtcaaacactcgcagaccccaagcgcctcatagcgaaacttagaattatctgtaatggtctaggcgatcccatcgcttcagaactgacagccggtgactttacgaaataccgcgaagcacggttaaaaggtgaagtacgaaatgaagatggcacgtttatgtcgcccgttaagccccgcacggtaaaccttgaacagcgcaatctatcatctgtttttggtacactgaaaaagctgggccactggtcagcccccaacccgcttgctgggctgccaacatttaaaattgctgagagtgaattggcgttcctgaccccggaagaaattaaacgtctgctggatgcctgcgccgattctcaaagctccagcctgcttttgattgcaaaaatatgcctggccaccggcgcacgctggagcgaagccgaaaacctgcagagtcatcaggtatcaaaataccgtatcacttataccaagaccaaaggcaagaaaaaccgaactgtgcctatttctaaggatttatatgaagaactgcctaagaatagggggaagttattcaccccatgcagaaaagcctttgagcgtgcagtaaagcgggctggtatcgatctgccagagggtcaatgtactcacgttctgcgtcatacattcgctagccattttatgatgaatggtggaaacatattggttttgcgggatatcctaggacattcagatataaaaatgaccatggtctatgcacacttcgccccagaccatttagaagatgccgtaactaaaaatcctttatttaatttgaggtaagtagtaatttatgaatagcgaactagagttacttataaaaatattattcccttccctatctgccattatatccttattagggcttaaaacagggtggacttataaaaaagacaaactattcacatcacgtaaaaacattagcgaattttcatatcagatgtataaaagcagtgaagatccgaccttcaaaaaactggcggaagattacggcattgctgcattaaccaaagataacacattgacaaaaaaacaaagattaatattactcaacacaacaaaccccgttagcgatatagatgattattccaaatgtcaaagtctaatttccattaccacccataaagaaatattcgcatggaataaaaaaagatataaatacagcatatatagaaaattaataaaaattataacaactctaatttacttcatgggcagtctcatcgtagcacttcctttcagttattctgttgtagtaagtgctaagatgatggagaagataaaccatctaactacttggcaatactttggtttaagcagctattttgtggtatcgggagtagcaatatgctttatctgcctagataagctctccaagattaagatcgccgagagattaatcgtttcaaataggcgtttaggcgacaaatgcagtggcggcactttggcggcagaaagttaaaaacccataaaacggacagacaccgcataaatctaaccaactgaaaatcaaagcaaatcattgtttttacagacattgaaatgctatgtaggaatttcggacgcgggttcaactcccgccagctccaccaatcatgattggacggtgtaaggactacaccaacaaaaacaggaagttataagtctcagcaggacaccgaccagacggtgaggagacaaaaaaggatacgcaacggagtcgcgactccctatgacattaaagcccgctgatgcgggcttttttattggtcctgacccgccctgaatagaattcatccaattacagtccagacatatacagtatccctcagctcagtatcagcttctcgacaaatggtcactgttatttacccgttgccagaaagagaataatttgcccccatagccagcctttccggaatctgtatattcattaatattgttatcgattccatcaagtaacataggttggatgcgattgatcttactcacattagtcgacacggaactcagtaagttgaactctggaaaagcagtttaaatagcatttaaacaaatgccaccagttcgaaaaagagtataagcacacttaatatattgttttaattattcatttcctttcaacccaattcttatccctcacattatttgttattaatttgttgtttttgatcacaataagaaaacaatatgtaacttttatgcgcatttttcagaaatgtagatatttttagattatggctacgaaatgagcatcgccatgtcaccctacatctcataagaggagcgcttctgatgaatgcactgaccgccgtacaaaataacgctgtcgattcaggccaggactatagcggattcactctcatcccgtcggcgcaatccccgcgtctgctggaactcaccttcaccgaacagacgaccaatcggttcctcgaacaagttgccgagtggcccgtgcaggcgctggagtacaaatcgtttctgcgttttcgggtaggcaaaattctcgacgatctgtgtgcgaatcagctgcaaccgctgctgttgaagaccctgttaaaccgcgctgaaggtgcgctgttgatcaatgcggtgggtatcgatgatgtcgcgcaggcggatgagatggtgaagctggcgacggcggtggcgcatctgattggtcgctccaattttgacgccatgagcggtcagtattacgcgcgtttcgtggtgaaaaatgtcgataactcagacagctatcttcgtcagccgcaccgcgtaatggagctgcacaacgacggcacttacgtggaagagatcactgattacgtgctgatgatgaaaatcgacgagcaaaacatgcagggcggtaactcgctgctgctgcatctcgatgactgggaacatctggacctctttttccgccatccgctggcgcgccgtccgatgcgctttgccgcgccgccgagcaaaaacgtcagcaaagatgtcttccatccggtgttcgatgtcgatcagcagggccgcccggtgatgcgctatatcgaccagtttgtccagccgaaagacttcgaagaaggcgtgtggttgagcgagctttcggacaccattgaaaccagtaaaggcactctttctgtgcccgttcccgttggcaaattcctgttgattaacaacctgttctggctgcacggtcgcgaccgctttactccacacccggatctgcgccgtgaactgatgcgtcagcgtggctatttcgcttacgccactcaccactaccagacgcatcagtaagcgcaaaggaattgagcggatgtatgattttgtgattattggcggcggcatcatcggcatgtcgaccgccatgcaactgattgatgtttatccggatgcccgcatagcgttgctggaaaaagagcccggcccggcctgtcaccagacgggccacaacagtggcgtaatccatgccggggtctattacacgcccggcagcctgaaggcgcagttttgcctggcaggaaaccgcgccaccaaagccttttgcgatcaaaacggtattcgctacgacaactgcggcaagatgctggtcgccacgtctgaactcgaaatggaacggatgcgcgcgttgtgggaacgcacggcggcgaacggtatcgagcgcgagtggttaaacgccgaggaactgcgcgagcgcgaaccgaatatcaccgggcttggcggcatttttgtgccgtccagcggcattgtcagctatcgcgaagtgacggcggcgatggcaaaaatcttccaggccagaggcggcgagattatttataacgccgaagtcagcgcccttagtgagcataaaaacggcgtggtgatacgtacccgtcagggcggtgaatatgaagcatcgacgctgattagctgttccgggctgatggctgaccggctggtgaaaatgctcggcctcgaaccgggctttattatctgcccgttccgtggcgagtatttccgccttgcgccggagcataaccagattgttaaccacctgatttaccccattcccgaccccgcgatgccatttttgggcgtgcatctcacccgcatgatcgatggcagcgtgaccgtcgggccaaacgcggtgctggcttttaaacgcgaaggctatcgcaagcgcgatttctcgtttagtgacacgctggagattttaggctcgtcggggattcgccgggtgctgcaaaaccatctacgctcaggattgggcgagatgaaaaactcgctgtgcaaaagcggctatctgcggctggtgcaaaagtattgtccccggctttcgttaagcgatctccagccctggcccgcaggtgtgcgggcgcaggcggtatcgccggacggcaagctgattgacgattttctgtttgtcaccaccccgcgcacgatccacacctgtaatgcgccctccccggcagcgacatcagcaattcctattggtgcgcatattgtcagcaaggtacaaacgctgttggcaagccagagtaaccccggacgcacgctgcgagcggcacgtagtgtggatgccttacacgccgcatttaatcaataacctttgaaaacaggacgtaacaatgaaacttaacgacagtaacttattccgccagcaggcgttgattaacggggaatggctggacgccaacaatggcgaggtcatcgacgtcaccaatccggcgaacggcgacaagctgggtagcgtacccaaaatgggcgctgatgaaacccgcgccgctatcgacgccgccaaccgcgctctgcccgcctggcgtgcgctcaccgccaaagaacgcgccaacattctgcgcaactggttcaatttgatgatggagcatcaggacgatttagcgcgcctgatgaccctcgaacagggcaaaccactggccgaagcgaaaggcgaaatcagctacgccgcctcatttattgagtggtttgctgaagaaggcaaacgtatttatggcgacaccattcccggtcatcaggccgataaacgcctgattgttatcaagcagccgattggcgtcaccgcggctatcacgccgtggaacttcccggcggcgatgattacccgtaaagccggtccggcgctggcggcaggctgcacgatggtgctgaagcctgccagtcagacgccgttctctgcgctggcgctggcagaactggcgattcgcgcgggcgttccggctggcgtgtttaacgtggtcaccggttcggcgggcgcggtcggtaacgaactgaccagcaacccgctggtgcgcaagctgtcgtttaccggctcgaccgaaattggccgtcagttaatggaacagtgcgcgaaagacatcaaaaaagtgtcgctggagctgggcggcaacgcaccgtttattgtctttgacgatgccgatctcgataaagccgtggaaggcgcgctggcctcgaaattccgtaacgccgggcaaacctgcgtctgcgccaaccgcctgtatgtgcagaacggcgtgtatgaccgctttgccgaaaaattgcagcaggcggtgagcaaactgcacatcggcaacgggctggagaaaggcgtcaccatcgggccgctgatcgatgaaaaagcggtagcaaaagtggaagagcatattgccgatgcgctggagaaaggcgcgcgcgtggtttgcggcggtaaagcacatgaacgcggcggtaacttcttccagccgaccattctggtggacgttccggctaacgccaaagtgtcgaaagaagagacgtttggccccctcgccccgctgttccgttttaaagatgaagccgatgtgattgcacaagccaatgacaccgaatttggccttgcagcctatttctacgcccgtgatttaagccgcgtcttccgcgtgggcgaagcactggagtacggcatcatcggcatcaacaccggcattatttccaatgaagtggccccgtttggcggcattaaagcctcgggtctgggtcgtgaaggttcgaagtatggcatcgaagattacttagaaatcaaatatatgtgcatcggtctttaactggagaatgcgaatgagcagcaataaagagttaatgcagcgccgcagtcaggcgattccccgtggcgttgggcaaattcacccgattttcgctgaccgcgcggaaaactgccgggtgtgggacgttgaaggccgtgagtatcttgatttcgcgggcgggattgcggtgctcaataccgggcacctgcatccgaaagtggtggcggcagtggaagcgcagttgaaaaaactgtcgcacacctgcttccaggtgctggcttacgagccgtatctggagctgtgcgagattatgaatcagaaggtgccgggcgattttgccaagaaaacgctgctggtcaccacgggttctgaagcggtggaaaacgcagtgaaaatcgcccgcgccgccaccaaacgcagcgggaccatcgcctttagcggcgcgtatcacgggcgcacgcactatacactagcgctgactggcaaggtgaatccgtactctgcggggatggggctgatgccggggcatgtttatcgcgcgctttatccttgcccgctgcatggcatcagtgaagatgacgctatcgccagtatccaccgaatcttcaaaaatgacgcagcgccggaagatatcgccgccatcgtgattgagccggttcagggcgaaggtggtttctacgccgcaacaccagcctttatgctgcgtttacgcgcgctgtgtgacgaacacgggatcatgctgattgccgatgaagtgcagagcggcgcggggcgtaccggcacgctgtttgcgatggagcagatgggcgtggcgccggatctcaccacctttgcgaaatcgatcgcaggcggcttcccgctggcgggcgtcaccgggcgcgcggaagtgatggacgccgtagcaccgggcggactgggtggcacctatgccggtaacccgattgcctgcgtagcggcgctggaagtgttgaaggtgttcgagcaggaaaatctgctgcaaaaagccaacgttctggggcagaagctgaaagacggattgctggcgatcgccaaaaaacacccggagatcggcgacgtacgcgggctgggggcgatgatcgccatcgagctgtttgaagatagcgatcacagcaaaccggacgcaaaactcaccgccgaaatcgtggcacgcgcccgcgataagggtctgattcttctctcctgcggcccgtattacaacgtgctgcgcatccttgtaccgctcaccattgaagacgctcagatccgtcagggtctggagatcatcagccagtgttttgctgaggcgaagcagtagcaccgcaccatgccggaggcgacgctgcgcgtcttgtccggcctacgagaatccaggtcggataaggcgtttacgccgcatccgacaatctgtacgtgaacaggaataaatctatgtcggccggataaggcggagccgctctccggcaaaaagaaccaataacaattaaacgcgtgacccgacgcgggaaatgtcggggcgctctcccaagtgacacactttcgagaggattcaggatggggcaatcatcgcaaccacatgagttaggcggcgggctgaagtcacgccacgtcaccatgttgtctattgccggtgttatcggcgcaagtctgtttgtcggttccagcgtcgccatcgccgaagcgggcccggcggtattactggcctatctgttcgccggattactggtggttatgattatgcggatgttggcggaaatggcggttgccacgcccgataccggttcgttttccacctatgccgataaagccattggccgctgggcgggctataccatcggctggttgtactggtggttttgggtactggttatcccacttgaagccaacatcgccgccatgatcctgcactcgtgggttccaggcattcccatctggttattttccctcgtcattaccctcgccttaaccggcagtaatttattaagcgttaaaaactacggcgaatttgagttctggctggcgctgtgtaaagtcatcgctatcctggcctttattttccttggtgcagtcgcaattagcggtttttacccgtatgccgacgtgagcggtatttcaagattgtgggatagcggcggctttatgcccaacggcttcggtgcggtattaagcgcgatgttgatcaccatgttctcgtttatgggcgcagaaattgtcaccattgccgccgcggaatccgacacgccggaaaaacatattgtccgcgccaccaactcggttatctggcgtatctctattttctatttgtgttctatttttgtcgttgtggcattaatcccgtggaatatgccagggctgaaagccgttggttcttatcgctcggttctggaattgctcaatattcctcatgcgaaattaatcatggactgcgtgatattactttccgtaaccagctgcctgaactcggcgctgtataccgcttccaggatgctctactccttaagccgtcgcggtgatgctcccgcggtaatgggtaaaatcaaccgcagtaaaaccccgtacgtggcggtgttactctccaccggcgcggcattcttaacggtggtggtgaactattacgcgcctgcgaaggtgtttaaatttctgatcgacagctccggcgctatcgccctgctggtttatttagtcatcgccgtttcacaattgcggatgcgcaaaattctgcgagcagaaggaagcgaaattcgcctgcggatgtggctttatccgtggctcacctggctggtaatcggttttattacctttgtgttggtagtgatgctattccgcccggcgcaacagttagaagtgctctccaccggcttattagcgattgggattatctgtaccgtgccaattatggctcgctggaaaaagctgataatgtggcaaaaaacacccattcataatacgcgctgataatgatcaggagtcacaccatgaccattacctctctggatggctatcgctggctgaagaacgatattattcgcggcaattttcagccggatgaaaaattacggatgagtttgctgacatcgcgttatgcacttggcgttgggccgttgcgggaagcgctttcgcaactggtggcagaacaactggtcacggtggtgaatcaaaaagggtatcgggtggcgtctatgtcagagcaggagctgctcgatattttcgatgcccgtgccaatatggaagcgatgctggtaagcctggcgattgcccgcggtagtgatgagtgggaggcagacgttcttgcgaaggcgcatctgctcagtaagcttgaggcctgtgacgccagtgagaaaatgcttgatgagtgggatctgcgtcatcaggcgtttcatactgcaattgtgacaggctgtggttctcactatttgctgcaaatgcgtgaacggttgtttgatctggcggcgcgctatcgcttcatctggctgcggcgaacggtactttccgtggaaatgctggaagataaacacaaccaacatcaaattttaaccgaagctgtgctggcgcgggatgccgcgcgcgccagtgagttaatgcgccagcatttgctgacgccgattcccattatccagcaggcgatggctggcaattaactactcttcaggaatacgcaacacttgccccgggtaaattttatccgggctttttagcatcggtttattcgcttcgaagattttattgtacagattagcgttaccgtagacctgtttggaaatggcactcagagtgtcgccagacttaacggtataaaactggctggcagtggctggtatcgccgttttcacctgatcatcgacactggcaataccggaaatattccccaccgcaacaaggattttctccttcgcctcctgacttaagccgtcaccagtgaccgtcgctttgccgtcggcaatttgaatgttcactttatcggcatcaggtataccggttttgttcagatgctcctgcaccttcttcgcctgatcgtctttatcgtgctgacctgtaaccgcgtcccagagtttttctccggcatctttcacaaaattgaacagacccatagctacctcattcgttaacggaaacactcagaaagtgtagcagaggaacgcggcgcgttaacgccgcgggggtgagcacaggtttaatcgcgggtttgcacccagaacgcgtgaatcaaaccggggatatagccaagcagtgtcagcagaatattaataatgaacgcccaaccgaaccctttaccgagcagcacgccgagcggcggcagaataatggtgatgacgattctccagaaacccatatgtactccctataagaaaattactcattgtttaaaaagagattttatctcttaagcgtagtaattttagcggagcctgccagtttcagcttacgcatttactctcatttacgcggctgaggctggtatatgttgcatttttagtttagagtttacttaatttagaaaatacttaaatatctatgactgaactcgcacaattacaggccagtgccgaacaggcagcggccttattgaaagcaatgagccaccctaaacggttgctgattctgtgcatgcttagcggttcccccggcaccagtgcgggagagctgacgcgcattaccggactaagtgcctctgcaacatcacagcatctcgctcgtatgcgggacgaggggcttatcgacagccaacgggatgcccaacgcattctatattccattaaaaatgaggcggtaaatgccattatcgccaccctgaaaaatgtctattgtccgtaaggagtcactatggctttgacaaccatttcgccgcatgatgcacaagaattaatcgcacgcggcgcaaagttaatcgatattcgtgatgctgatgaatatcttcgtgaacatattcctgaagcagatctggctccattatccgtactggaacagtcaggtcttccgcctaaattacgtcgcgagcaaattatattccactgccaggcaggtaaacgcaccagtaataacgccgataaattagcagcgattgccgcccccgcagaaatctttttactcgaagatgggattgatggctggaaaaaagcaggattgccagtagcggtaaataaatcccaacccttgccgttaatgcgccaggtgcagatcgccgcgggtggtttaatattaatcggcgttgtactgggttataccgtaaatagcgttttcttcttattaagcggctttgttggtgctgggttactgtttgcaggaattagtggtttttgtggaatggcaaggttgttagataagatgccgtggaaccaacgagcttgagaagcgacgccggacgcgccatagcagcgacatccggcctcagtaattagatcaggaaatcgtcgagagatttaccttctgccagcgcctgagcgattggcttcggtgtacggccctgaccggtccaggttttagtttcaccgttaacatcgatgaatttatatttcgccggacgcggctggcgttttttaccagcgcgtggtgccgcagcagagctattacccaataactcttccgggttaattccgtcagctttcatcagctccagccaggtgctaattttttcctggcgctctgccagttcacgctgctgttgttcttcttcttcacgtctttctttagtgacaaccctgaatttttcgagcatttcttcaagaacgtcaatggagaattcgcgagccatcgcacggagggtgcgaatgttatttaaactttgtaacattacggacataataaagaaaaccttttaacccaaaacaaaaaagtatttcgtcgcgtagtgtaagcgatcacttattatatttccacaaaatttaatctatttacagtcctgcacgagattatttcagctgttattttctgaaactctcagaataatttcaagattatatattagccattttgatgagtaatttcggttattggtgaacagagcggctctctctgctcgataattccgcaagcctgacaaaaccaaagcgaataaaaatgcaatttaaccgaataaaagaaaacatctatcactggtgctttctgctgtcaatgtacattatctggcataaaaaatgctgaaaatgacccggtcactacatacaccgaattctctacgcttatagcgttacctcacacccaaaccttcatgagtgaaaacaaaggtaaacacatatccaattgatttaattaaaaataaatcataccggcatgtaaaaatccacaatgtacaaaaaacgcgccgttacggaatattttatctacaaaaacagattaaataaaaatttttcactaattgattagtcatagccagcgatatacgctatgcgaaaatgcagatggcaatgagatccgctgctttcatctccattaacatcccattacgcttttattaaggagcattagcatgttctcaccgcagtcacgcttgcgtcatgcagttgcagatacgttcgcgatggttgtttactgttctgtcgtgaacatgtgtattgaagttttcctctccggaatgagcttcgaacagtctttttattccagattggtagcgattccggtgaacatcttaattgcatggccatacggtatgtaccgcgatctgtttatgcgcgcggcacgcaaagttagcccgtcgggctggataaaaaatctggcggatatcctggcttatgtgacgttccagtcaccggtgtatgtggcgatcttgttagtggtggacgcagactggcatcagattatggcggcagtcagttcaaacatcgttgtttcgatgttgatgggggcggtttatggctacttcctcgattattgccgccgactgtttaaagtcagccgttaccagcaggtaaaagcctgacccttcttttcgcgactggcatcgccagtcgcgtctttaactggcttcgccaaataaaccattcaaataacgttcaagcgcaacacgcgaactaaagccatgcgggataccgtaatgctcatgacgttcacccgctaaatagagcggaaattgctggtaatgatcgcaagttttaatatcggaagcgggttcagccagtgttgaactacgttcttttaatgttggatgaatcaccagggcggtacgtcccattcgcgcttcgcgattaacatagacataattttccccacggcggtaaccatacgctttctgggttaccacatcgacagtaaaaccgactttttcaagtacgcgcgccacctcgtctggtcgtaaatacatatttgatcctcgttattatcaaccgcgggcctaccttacctgattgcgcattcacaacgctttcagaaaagtccataaagccgcgatgaacctcagttaagaaaattatggtctacactgaaaattacatcgaattctaatgggggatcatatgtttaaccgaccgaaccgcaacgacgttgatgatggcgtgcaggatatccagaatgatgtcaatcaattagctgacagtctcgaatctgtattgaagtcctggggcagcgacgccaaaggggaagccgaagccgctcgtagtaaagcgcaggctctactgaaagaaaccagggcgcgaatgcatggtcgtactcgcgtccagcaagccgcgcgcgatgccgttggctgcgcggattcttttgttcgtgaaagaccctggtgtagtgtgggtacagcggcagcggtgggtatttttatcggcgcactgttaagcatgcgcaaatcgtagtgcaaaaatgataataaatacgcgtctttgaccccgaagcctggcttcggggttttttagcttaaggctttacgtaattgttgtgctacctgtcgcgccataccttcgttaacgatattagtaaacgaaagcagtaatccaccttccccacttgaacggatacgccagtcgctaagtgcctgcaccgcaaggcctgcagcattggctttacgcgcatgggcaatatcatcgcctatcattctgatcaccatctggataccacctttctgcggcacaacctgaaatccttgctgcgtcaacgcttgctcaatccattgccgacgttgagcataatgctgacgcattttcttcagatgccgccagaaatgcccctcgcgaagaaagtctgccagtgtgttctgccatagaacaggtaccgcacatggagccagtgacgcctggtggcggaattgtgcaatttgcttcaccggcaccaccagccacgcacagcgcaatgcaggaaatagcgctttgctgaatgttccggcataaattacccgctgcggtgcgtcgagactttttaacgccggtaacggcttaccgtgatagcgaaactcactgtcataatcatcttcaataatccatgcctgactacgatctgcccattccagtatctgatgcctgcgcgctaaagagagcgccacacccagcggactttggtgtgctggtgttatcagggcaaaacgcgcatcaggataattttgtattccgcttgtgatatccagtccattgtcatcaaccggcacaggcaaaatttccacatcatggcgagtgacaatcgggcgaatcagtggaaagccgggatcttctatccacatcccgtttcccggtttcgccagcgcgtgcagaattaaagctattgaggccgcataaccgtgagtgataaagacctgctctggctgacaatcaatcccacgtgaaacgcgtaagtaatcaactattgcctcgcgcaacgccgcctcaccgcagacatcgcctaacgccaaatcaaagcgcgtctgggtacgaaggcgacgccccatcacccgcgcccacagctctcgcggaaagagatcgagtgcgggtaatcccatttgaaatggcaacggttgctgactttcaccggcaaaagctacaacttgtacagtagattgttgcggatatatccgctcactgacaaatgtgccagcctgtccccgcctgatcagccatccttgcgccaccagctcagcatacgcattttcgacagtggatcgagacacccccagctcctgcgaccaggtacgacttgaaggcagccttgctccgggtttcagttccccttgctcaatagccgtttttaactgacgggcgatatcctgatagcgcggcatatggtctgcttttttaggtaatttatggctctctttagcagtccattatagtgctacattgcgggcgttaataagaggagaaactgtatgactacattacgtcagccttactacgaacttagcccggcagtgtataacgcactagtgcaggccaaaacggcactggaaaatagcacgctggataccacgttgatggagttagtttatttgcgcatctcgcaaatcaacggctgcgcattttgtctggagatgcacagcaaagcattgcgcaaatccggcgtgccacagcacaaactggacgccctggcaggttggcgcgtaagccatcattttgatgaacgcgagcgggcggcgctggcatgggcggaatcggtaaccgaaattgccagaacccatgcggaagacgaggtttatcagcctttgcttgagcatttcagcgcagcagagatcagcgacttaacgtttgccatcgggctgatgaattgttttaaccgtctggccgtttccatgcggatgtaacttcttgatgccgggtatttgcccggcaaaaaacacaaaatcccctaccccgttgagccattcatcggtggcgtaatcaatctaaaattcccatatcttgtgtggttgaatcttttttcaactacatctagtatctctgtatcaacagagagacaacccgacgcgtatcatcgcgccgtatcttcattttaaacggaaatacgaatcatgcgcattactatttacactcgtaacgattgcgttcagtgccacgccaccaaacgggcgatggaaaaccggggctttgattttgaaatgattaatgtcgatcgcgttcctgaagcggcagaagcgctgcgtgctcagggctttcgtcagttgccggttgtgattgcaggcgatcttagctggtctggtttccgcccggacatgatcaatcgtctgcatccagcgccacacgcggccagtgcatgagccagctcgtctacttttccagcagctccgaaaatacgcagcgttttatcgaacgtttagggctgcccgcggtgcgcatcccgctcaatgagcgggaacggattcaggtagacgagccttacatcctgatcgtgccctcttacggcggcggcggtacggctggcgcggtgccacgacaggtcattcgctttttaaacgacgagcataaccgggcgttgctgcgcggcgttattgcttcgggtaatcgcaactttggtgaggcatatggccgcgccggagatgtgattgcccggaaatgcggcgtgccgtggctgtaccgctttgaactcatgggtacgcaaagcgatatcgaaaacgttcgtaaaggagtaaccgaattttggcaacgacaaccgcagaacgcctgacgcaggaaacgatggattatcacgctctgaatgcgatgcttaacctttacgatagcgcaggtcgcattcagttcgataaagacagccaggcagtagacgcctttatgacgacgcatgtgcgtccgaacagtgtggccttcagtagccagcagcagcgcctgaactggctggttaacgaaggttactatgatgaaagtgtccttaatcgctactctcgcgattttgtcattacgctgtttgcccacgcgcacgccagcggttttcgtttccagacattcctaggagcatggaagttttacaccagctatacgttgaagacattcgacggtaagcgttatctggaagattttgccgatcgcgtcacgatggtggcgctgacgctggcacaaggcgatgaaacactggcgacgcagctcactgatgagatgctgtcaggacgctttcagccagccacgccaacattcctcaactgcggtaagcagcagcgcggcgaactggtttcctgttttctgctgcgtattgaagacaatatggagtcgattggccgggcagtaaattccgcactacaactgtcgaaacgcggcggcggcgtagcatttttgctgtctaatctgcgggaagcgggcgcgccaattaaacgtattgaaaatcaatcttctggcgtgattccggtgatgaaaatgctggaagacgcattttcctatgccaaccaactcggcgcgcgtcagggggctggggcagtctatttacatgctcatcatcccgatattctgcgttttctcgatacaaaacgggaaaatgccgacgaaaaaatccgcattaaaacactgtcgctgggcgtggtgatcccggatatcactttccatctggcaaaagagaatgcgcagatggcgctgttttcgccctatgacgtagagcgagtttatggcaagccgtttgccgatgtcgccatcagcgaacgctatgacgaactggttgccgatgaacgcattcgcaaaaaatacctcaacgcccgtgatttcttccagcgactggcagaaatccagtttgagtccggctatccctacatcatgtatgaagacacggttaaccgtgctaaccctatcgccgggcgcataaatatgagcaatctctgctcagaaattttgcaggttaacagtgcctcagagtatgacgagaatctcgactatgcccgtacaggccatgatatttcctgcaatttaggttcgttgaatattgcccacaccatggattcccccgactttgcccgcacggtagagactgccgtacgcggtttaacggcggtgtcagatatgagtcatatccacagcgtaccgtccatcgaagccggaaatgccgcctcacacgccatcggtctggggcagatgaatttacacggttatctggcacgagaaggcatcgcttatgggtcgccggaagcactggatttcaccaatctctatttctataccatcacctggcacgcactgcgtacctcgatgttgctggcgcgcgaacgcggtgaaaccttcgccgggttcaaacagtcacgctatgccagtggtgaatatttcagccaatatctgcaaagtaactggcaaccgaaaacggcgaaagttggcgaactgtttgcccgtagtggtattacgttacctacccgtgagatgtgggcgcagctgcgcgacgacgtgatgcgctatggcatatacaaccagaatctccaggcggtgccgccaaccggttctatctcttatatcaaccatgccacgtcgagtattcatccgattgtggcgaaagtagagatacgcaaagagggcaaaaccgggcgcgtttactaccctgccccgtttatgactaacgaaaatctggcgctgtatcaggacgcttacgaaatcggcgcagaaaagatcatcgacacctacgcggaagcgactcgccatgtcgatcaggggctgtcgctgacgctgtttttccccgataccgccaccactcgcgatatcaacaaagcgcagatttacgcctggcgcaagggtatcaaaacgctctattacattcgcctgcgtcagatggcgctggaaggcactgaaattgaaggctgcgtctcctgtgcactttaaggaatatctatgaaactctcacgtatcagcgccatcaactggaacaagatatctgacgataaagatctggaggtgtggaatcgcctgaccagcaatttctggctaccagaaaaggtgccactgtcgaacgatatacctgcatggcagacattaagtgtcgtagaacaacaactgacaatgcgcgtttttactggcctgacgctgctcgacacgctgcaaaatgttatcggcgcgccttcgctgatgcccgatgcgctcacgcctcatgaagaggcagtattatcgaatatcagctttatggaagcggttcatgcccgctcttacagttcaattttctcgacgctgtgccagaccaaagatgtcgatgccgcctacgcctggagtgaagaaaacgcgccgttgcagcgaaaagcacagattattcagcaacattatcgcggtgatgatccgctgaaaaagaaaatcgccagtgtgtttcttgaatcttttttgttctattccggtttctggctgccgatgtatttttccagccgcggaaagctaaccaataccgcagacctgatccgtctgattatccgggatgaagcagtccacggttactacatcggctataaatatcagaaaaacctggaaaagatctcccaggcacgacgtgaagagttgaagagtttcgccttcgatttgttgctggaactctatgacaacgagttgcaatacaccgatgagctgtacgccgaaaccccgtggtctgacgatgtaaaagcgtttctctgttacaacgccaataaggcgttgatgaatctgggctacgaaccgctatttcccgcagaaatggcggaagtgaatccggcaatcttcgccgcgctttcgccgaatgccgatgaaaatcacgatttcttttccggttcaggctcttcatatgtgatgggaaaagcggtcgaaacagaagatgaagactggaatttctgagggtgttatttttcaaaaatatcactacccgcagcagggaaataattcccgccaaatagctttttatcacgcaaatattttgtggtgatctacactgatactctgttgcattattcgcctgaaaccacaatattcaggcgtttttttgctatctttgacaaaaaatatcaacctttctcgatttgctctcagcccttatatcatgggaaattccggcgatttgctcacatcaatattcatgccacatttgccatcaggggttgcctcagattctcagtatgttagggtagaaaaaagtgactatttccattgggtaatgtatcgacataaacaaataacaggaatctttctattgcatggcaattaaattagaaattaaaaatctttataaaatatttggtgagcatccacagcgagctttcaaatatatcgaacaaggactttcaaaagaacaaattctggaaaaaactgggctatcgcttggcgtaaaagacgccagtctggccattgaagaaggcgagatatttgtcatcatgggattatccggttcgggtaaatccacaatggtacgccttctcaatcgcctgattgaacccacccgcgggcaagtgctgattgatggtgtggatattgccaaaatatccgacgccgaactccgtgaggtgcgcagaaaaaagattgcgatggtcttccagtcctttgccttaatgccgcatatgaccgtgctggacaatactgcgttcggtatggaactggccggaattaatgccgaagaacgccgggaaaaagcccttgatgcactgcgtcaggtcgggctagaaaattatgcccacagctacccggatgaactctctggcgggatgcgtcaacgtgttggattagcccgcgcgttagcgattaatccggatatattattaatggacgaagccttctcagcactcgatccattaattcgcaccgagatgcaggatgagctggtaaaattacaggcgaaacatcagcgcaccattgtctttatttcccacgatctcgatgaagccatgcgtattggcgaccgaattgccattatgcaaaatggtgaagtggtacaggtcggcacaccggatgaaattctcaataatccggcgaatgattatgtccgtaccttcttccgtggcgtcgatattagtcaggtattcagtgcgaaagatattgctcgccggacaccgaacggcttaattcgtaaaacccccggcttcggcccgcgttcggcactgaaattattgcaggatgaagatcgcgaatatggctacgtcatcgaacgtggtaataagtttgtcggcgcagtgtctatcgattcgcttaaaaccgcgttaacgcagcagcaaggtcttgatgcggcgctgattgatgcgccgttagcggtcgatgcacaaacgcctcttagcgagttgctctctcatgtcggacaggccccctgtgcggtgcccgtggtcgacgaggaccaacagtatgtcggcatcatttcgaaaggaatgctgctgcgcgctttagatcgtgagggggtaaataatggctgatcaaaataatccgtgggataccacgccagcggcggacagtgctgcacaatccgcagacgcctggggtacaccggcgactgcaccgaccgacggcggtggcgctgactggctgaccagtacgcctgcgccaaacgtcgagcattttaatattctcgatccgttccataaaacgctgatcccgctcgacagttgggtcactgaagggatcgactgggtcgttacccattttcgtcccgtctttcagggcgtgcgcgttccggttgattacatcctcaacggtttccagcaattgctgctgggtatgcccgcgccggtggcgattatcgttttcgctctcatcgcctggcagatttccggggtcggaatgggcgtggcgacgctggtttcgctgattgccatcggcgcaatcggtgcctggtcacaggcaatggttaccctggcgctggtgttaacagccctgctgttctgtatcgtcataggtttgccgttggggatctggctggcgagaagtccgcgagcggcgaaaattattcgtccactgcttgatgccatgcagaccacgcccgcgtttgtttatctggtgccaatcgtcatgctgtttggtatcggcaacgtgccgggcgtggtggtgacgatcatctttgcgctgccgccgattatccgtctgacgattctgggaattaaccaggttccggcggatctgattgaagcctcgcgctcattcggtgccagcccgcgccagatgctgttcaaagttcagttaccgctggcgatgccaaccattatggcgggcgttaaccagacgctgatgctggccctttctatggtggtcatcgcctcgatgattgccgtcggcgggctgggtcagatggtacttcgcggtatcggtcgtctggatatggggcttgccaccgttggcggcgtcgggattgtgatcctcgccattatcctcgaccgcctgacgcaggccgttgggcgcgactcacgcagtcgcggcaatcgtcgctggtacaccactggccctgtcggtctgctgacccgcccattcattaagtaactctgcacttgcccggtgacgccgggcatatcaccctgccaaaaaaaggaataacaatgcgacatagcgtactttttgcgacagcgtttgccacgcttatctctacacaaacttttgctgccgacctgccgggcaaaggcattactgttaatccggttcagagcaccatcaccgaagaaactttccagacactgctggtcagccgcgcgctggagaaattaggttataccgtcaataaacccagcgaagtggattacaacgttggctacacctcgcttgcttccggcgatgcaaccttcaccgcagtgaactggacgccactgcatgacaacatgtacgaagctgccggtggcgataagaaattttatcgtgaaggagtatttgttaacggcgcggcacagggttacctgatcgataagaaaaccgccgaccagtataaaattaccaacatcgcgcaacttaaagatccgaagatcgccaaactgttcgataccaacggcgacggtaaagcggatttaaccggctgtaacccaggctggggctgcgaaggtgcgatcaaccaccagcttgccgcgtatggactgaccaataccgtgacgcataatcaggggaactacgcagcgatgatggctgacaccatcagtcgttacaaagagggtaagccggtgttttactacacctggacgccgtactgggtgagtaacgaactgaaaccggggaaagatgtggtctggttgcaggtgccgttctccgcactgccgggcgataaaaatgccgataccaaactgccgaatggcgcgaattacggcttcccggtcagtaccatgcatatcgttgccaacaaagcctgggccgagaaaaacccggcagcagcgaaactgtttgccattatgcagttaccagtggcagatattaacgcccagaacgccattatgcatgacggcaaggcctcagaaggcgatattcagggccacgttgatggttggatcaaagcccaccagcagcagttcgatggctgggtgaatgaagcgctggcagcgcagaagtaatttttattcgggcggataaggcgcttttgcctcatccgccgctctgtacacaatgcctgatgcgatgcggccgcgtcttatcatgcctacaaaccacaccgcacatttcaacaatctatctttcatcccatattcatcaacatccgctattattgatttccagcttaatcatcacctgataaacaaaaacaatgactaaaaccaatcatgagcttagcccggcgctgatcgtgctgatgtctatcgccaccggtctggcggtagccagtaactattacgcccagccattgctcgacaccatcgcgcgtaacttttccctttccgccagttcggcaggctttattgttaccgccgcgcagttaggctatgccgccggtctgctgtttcttgttcccctcggtgatatgtttgaacgccgccgcctgattgtctcgatgaccttactggcagctggcggtatgttgattaccgccagcagtcagtcactggcgatgatgatcctcggtacggcattaaccggtttattctcggtcgtggcacaaattctggttccgctggcagcgacgctggcttcaccggacaaacgcggcaaagtggttggcaccattatgagcggtctgctattggggatcttactcgcacggaccgttgccggattgctggcgaatctcggcggctggcgtaccgtcttttgggttgcttcgatgttaatggcactgatggcgctggcattatggcgtggtctgccacaaatgaaatcagaaacccacctcaactacccacagttgttgggttccgttttcagcatgtttatcagcaataagatcctgcgcacccgcgcgttgctgggctgcctgacctttgccaacttcagcattctctggacctcaatggcctttttgcttgccgctccaccttttaactacagcgatggtgtaattggtctgtttgggcttgcgggagctgccggagcgttgggcgctcgtccggcgggcggttttgccgataagggcaaatcgcaccacaccacaactttcggtctgctgctgctgttactttcatggctggcaatctggtttggtcacacttccgtactggcgctgattatcagcatcctggtgctggacctcaccgtgcagggcgtgcatatcactaaccagacggtaatttatcgaatacaccctgatgcgcgtaatcgcctgaccgcaggttacatgaccagctactttattggcggtgccgctggttcgctaatttcagcctcagcctggcaacatggcagttgggctggcgtgtgtctggctagcgcgacgattgccctagttaacttactggtctggtggcgaggttttcatcgtcaggaagccgcaaattaagcaatcagcaaccgttttcgtggctttacacttataagggtgttaagaagcccatcagtctgataaggttaagatattcattcagtctatttataatattaacaatcgttaagcgtacactctatggaaagccctactccacagcctgctcctggttcggcgaccttcatggaaggatgcaaagacagtttaccgattgttattagttatattccggtggcctttgcgttcggtctgaatgcgacccgtctgggattctctcctctcgaaagcgtttttttctcctgcatcatttatgcaggcgcgagccagttcgtcattaccgcgatgctggcagccgggagtagtttgtgggttgctgcactgaccgtcatggcaatggatgttcgccatgttttgtatggcccgtcactgcgtagccgtattattcagcgtctgcaaaaatcgaaaaccgccctgtgggcgtttggcctgacggatgaggtttttgccgccgcaaccgcaaaactggtacgcaataatcgccgctggagcgaaaactggatgatcggcattgccttcagttcatggtcatcgtgggtatttggtacggtaataggggcattctccggcagcggcttgctgcaaggttatcccgccgttgaagcagcattaggttttatgcttccggcactctttatgagtttcctgctcgcctctttccagcgcaaacaatctctttgcgttaccgcagcgttagttggtgcccttgcaggcgtaacgctattttctattcccgtcgccattctggcaggcattgtctgtggctgcctcactgcgttaatccaggcattctggcaaggagcgcccgatgagctatgaggttctgctgcttgggttactggttggcgcggcgaattattgcttccgctatctgccgctgcgcctgcgtgtgggtaatgcccgcccaaccaaacgtggcgcggtaggtattttgctcgacaccattggcatcgcctcgatatgcgctctgctggttgtttctaccgcaccagaagtgatgcacgatacacgccgtttcgtgcccacactggtcggcttcgcggtactgggtgccagtttctataaaacacgcagcattatcatcccaacactgcttagtgcgctggcctatgggctagcctggaaagtgatggcgattatataacccacaagaatcatttttctaaaacaatacatttactttatttgtcactgtcgttactatatcggctgaaattaatgaggtcatacccaaatggatagttcgtttacgcccattgaacaaatgctaaaatttcgcgccagccgccacgaagattttccttatcaggagatccttctgacccgtctttgcatgcatatgcaaagcaagctgctggaaaaccgcaataaaatgctgaaggctcaggggattaacgagacgttgtttatggcgttgattacgctggagtctcaggaaaaccacagtattcagccttctgaattgagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccgccgcagcataactgcctgcatcaactctggtccgcgctcagcacaacagaaaaagaccagctcgagcaaatcacccgcaaattgctctcccgtctcgaccagatggaacaggacggtgtggttctcgaagcgatgagctaacgcgtcatctcgctcaaaaatccagatttataaaagaaaaaataaccggccagcatcgcaacatgctggcctttttggcaagcaggtcggctcagccgatgagttaagaagatcgtggagaacaatatgagcgcaaatgcggagactcaaaccccgcagcaaccggtaaagaagagcggcaaacgtaagcgtctgctcctccttctcaccttgctctttataattattgccgtagcgatagggatttattggtttttggtactgcgtcatttcgaagaaaccgatgacgcatacgtggcagggaatcagattcaaattatgtctcaggtgtctggcagcgtgacgaaagtctgggccgataacaccgattttgtaaaagaaggcgacgtgctggtcactctcgacccgacagatgctcgccaggcatttgaaaaagccaaaactgcactggcttccagcgttcgccaaacccaccagctgatgattaacagcaaacagttgcaggcgaatattgaggtgcaaaaaatcgccctcgcgaaagcacaaagcgactacaaccgccgtgtgccgctgggcaatgccaacctgattggtcgcgaagagctgcaacacgcccgcgacgccgtcaccagtgcccaggcgcaactggacgtcgctattcaacaatacaatgccaatcaggcgatgattctggggacgaaactggaagatcagcctgccgtgcaacaggctgccaccgaagtacgtaacgcctggctggcgctggagcgtacccgtattgtcagtccgatgaccggttatgtctcccgccgcgcggtacagcctggggcgcaaattagcccaacgacgccgctgatggcggtcgttccagccaccaatatgtgggtggatgccaactttaaagagacgcagattgccaatatgcgtatcggtcagccggtcaccatcaccaccgatatttacggcgatgatgtgaaatacaccggtaaagtggttggtctggatatgggcacaggtagcgcgttctcactgcttccggcgcaaaacgccaccggtaactggatcaaagtcgttcagcgtctgcctgtgcgtattgaactggaccagaaacagctggagcaatacccgctgcgtatcggtttatccacgctggtgagtgtcaataccactaaccgtgacggtcaggtactggcaaataaagtacgttccacaccggtcgcggtaagcaccgcgcgtgaaatcagcctggcacctgtcaataaactgatcgacgatatcgtaaaagctaacgctggctaatccagaggtgcgtgtgatgcaacagcaaaaaccgctggaaggcgcacaactggtcattatgacgattgcgctgtcactggcgacattcatgcaggtgctggactccaccattgctaacgtggcgatccccactatcgccgggaatctgggctcatcactcagtcagggaacgtgggtgatcacttctttcggggtggcgaatgccatctcgatcccgcttaccggctggctggcaaagcgcgtcggggaagtgaaattgttcctctggtcaaccatcgcctttgctattgcgtcgtgggcgtgtggtgtctccagcagcctgaatatgctgatcttcttccgcgtgattcaggggattgtcgccgggccgctgatcccactttcgcaaagtctattgctgaataactacccgccagccaaacgctcgatcgcgctggcgttgtggtcgatgacggtgattgttgcgccaatttgcggcccgatcctcggcggttatatcagtgataattaccactggggctggatattcttcatcaacgtgccgattggcgtggcggtggtgttgatgacactgcaaactctgcgcggacgtgaaacccgcaccgaacggcggcggattgatgccgtggggctggcactgctggttattggtatcggcagcctgcagattatgctcgaccgcggtaaagagctggactggttctcatcacaggaaattatcatcctcaccgtggtggcggtggtggctatctgcttcctgattgtctgggagctgaccgacgataacccgatagtcgatctgtcgttgtttaagtcgcgcaacttcaccatcggctgcttgtgtatcagcctcgcgtatatgctctacttcggcgcgattgttctgctgccgcagttgttgcaggaggtctacggttacacggcgacgtgggcagggctggcctctgcgccggtagggattattccggtgatcctgtcgccgattatcggccgcttcgcgcataaactggatatgcgccgactggtaaccttcagctttattatgtatgccgtctgcttctactggcgtgcctatacctttgaaccgggtatggattttggcgcgtcggcctggccacagtttatccagggttttgcggtggcctgcttctttatgccgctgaccaccattacgctgtccggtttgccaccggaacgactggcggcggcatcgagcctctccaactttacgcgaacgctggcggggtctatcggcacgtcgataaccacgaccatgtggaccaaccgcgagtcgctgcaccatgcacagttgactgagtcggtaaacccgttcaacccgaatgctcaggcgatgtacagtcaactggaagggctggggatgacgcaacagcaggcctctggctggattgcccagcagatcaccaatcaggggctgattatttctgccaatgagatcttctggatgtcggcggggatattcctcgtcttgctggggctggtgtggtttgctaaaccgccatttggcgcaggtggcggcggaggcggtgcgcactaagtacaactaagccagttcatttgaactggcttttttcaattaattgtgaagatagtttactgactaaatgtgcagttcctgcaacttctctttcggcagcgccagttcttcgttgctgttgatgcgcacgtcacgttccagaatgttacgcgcaatatcctgcgcttcctgcaacgagtgcatctggtaagtgccacactggtagacgttcagttccgggatctgattctgatcctgcactttcagcacgtcttccattgccgctttccaggcatcagcgacacgctgctcatctggcgtaccaatcagactcatataaaaaccggtgcggcagcccattggcgagatatcgataatctctacgccattaccgttaagatggttacgcataaaaccagcaaacaggtgctccagggtatggatccctctttctggcatcacttctttgttcggcacgcagaagcgcagatcgaacacggtgattgcgtcgccatgcggggtgttcattgtttttgccacccgaactgcaggcgcttccatccgggtatgatcgactgtgaagctatctaacaacggcatttagccacctccggtaatttttttaaaaattttctgaactctttgttcccaggcgagtctgagtatatgaaagacgcgcatttgttatcatcatccctgaattcagagatgaaattttggccactcacgagtggcctttttcttttccgtcaggcgtgcttttccagccacaccgcaaacggttcggtatcagcggcttccatttcctgctgacggcgttcagacgcctcgcgctcggcgacaaaatcctcttcgcgcagaatttccagcggctcttcacgcagcagattacggtacgcttcagcaaacgctttgcctgttccgccaataccagtatcaatcatagaccttaagatacgggcagagaaagtcagatcgggattatcgaagcaggcgaccagttcatcacacactttctgatacgcttcgccgccgttaatgctatccagcgtttgcgcgacgcgtttcagatcgcggaacagatctttacccacctgcggtaacgggaactgcgcagtttcgcagccgatacccagcgtcaggcccggtttgcgaccttcgaggatcacccggttccagttaacgcgtgtacaggcaagttcgctactgctcatttccggtgcgtcagccagcgcacaccagaccataaacaggtcgaggaatcgcacctgttgttcatctacaccaatcggcgagaacgggttgatatccagcgagcggacttcaatatattcaatgccgccacgtaacagcgcatcagaaggcgactcaccactgcgggtaacgcgtttgggacgaatcggcgcgtacagttcgttttcaatctgcagcacattgctgttgatttgcagccgcttaccgtctttctcaataccaatcttcgcgtactcttccgatggcgttttgattgcctgtttaaggcccgccacgtactcgtagagatcattgaaggtgataccaagattgctttgcgatttattggtatagccgagatcgctcaaacgaagagaggtcgcatacggcaggtaatacataccgcactcggttttctcaaacggcagcgacgttggttttccttgcaagaaagaagaacaaatcgctggagacgcaccaaacagataaggaatgacccaaccgaagcgatagtagttacggataacacggaaataacccgcagatattttctctttggcatcagcgcccgagatatcaccgcacttcgcttgccagaatgccattggcaaagagaaattatagtgcacgccggaaatggtttgcatcagcgcgccgtagcgatttttcagcccttcacggtacagcgttttaaagcgaccggtgttagaagtgccgtactgtgccagttcgatgtcctgaccttctgcgatatagcatggcatacttaacggccacatccgctcatcgcccatattgcgcgccgtatagcgatgcagatcgcgcataaaggtcagcatatgttcaatatcaccatccactggtgtaataaattccagcaatgcttccgcaaaatcggtagtaatccatttatgggtcagtgcagaacctaatgcttcaggatgacctgttgttgccagtgtgccatcagcattaacacgcaaagtttcgcgctccagcccacgctgtatcccctttaacgcctgaggatgtttttccagccaggccagcgcctgtgatacgtccgggatcaaattgacctcccgcctgtcaaaatcgttttaattagcataactgtaatggtgaccatatgtgcaggcctacaattagtgccaccacatcatgccctgaacggtagctgctgcaactgcaacatagcgtaacgctttaccaaggcacaaaaaaaagattaccggtccccacgagatgcgcatccatcccgctaacagacacagtaaatcgccaaccacgggcatccagcttaataatagcgtgactgcaccatagcgtatcagccagccggtagctttctcttgccagcgcgatgttttacgcaatggaaagaaacgcccaaggataacgttagttaaccctccaaggctattacccattgttgctgttaaaactaaaacccagggatgactgatcccggaaagcaacattgccaccagcacgacttcggagttgccgggtaatagtgtagcgctgagaaaactactggcaaacaacgagaaaagcgataacgcttcactcacagcaagcgaacatccacggcgtccatgcctgctgcacgggccgcctgaataccgaaatcggcatcttcaaagaccacacactgcgtcggttgcacgcccatacgctgcgcgcacaacaaaaatgtgtctggcgcgggtttatggtgtttgacgtgatcggcagcgacgacagcgtcaaaataacggcgtaatcccaggtgtgccagcaatgcctcagcgatggcgctttcactccccgttcctacagccattgggcgacgaccatgccagcttttcaccacttcaacaagaggaagcggctcgacactatccagcagcatacttcttactgcttctgttttttcacgcgctaacgcatgcgggtcgagatcggcctgattcagctcaataatcgcctgagcaatacgccaggtgggcgagccattaagcgcaatcatcgcctgaacatcgtactgaagaccgtagtgccctaatacttcgcgccacgctttagggtgcgtaggctcggtatccaggatggtgccatccatatcaaaaattaaacctgcataacgctcgtacatggtcttctcgcaagtagaaaaatatgacgctactttagcgtaattgcttgattttgtcgctgatggagaaggagaagaaaattcaggaaatggataaagtagttatttagaaatgagatatttttgaaggaaattttttggagaatatggtgcatccgggaggatgactcactggcgttcgcccttcgggccgctgctggcgcaacgttatcctccctggtgcctgcggttaataccgctacctcttcgataccttcattgctgaaggttacggagaatatggtgcatccgggaggattcgaacctccgaccgctcggttcgtagccgagtactctatccagctgagctacggatgcatcggaaaaatttattttactgctgatattgatatcgctactaaagccatatcaagtaagagatggtgcatccgggaggattcgaacctccgaccgctcggttcgtagccgagtactctatccagctgagctacggatgcatcgggaaatttattttactgctgatattgataccgccactaaagctatatcaagtaagagatggtgcatccgggaggattcgaacctccgaccgctcggttcgtagccgagtactctatccagctgagctacggatgcatcgggaaacttactttactgcagattttttgataccgccactaaagtcgtatcaagtaagagatggtgcatccgggaggattcgaacctccgaccgctcggttcgtagccgagtactctatccagctgagctacggatgcaaatggcggtgaggcggggattcgaaccccggatgcagcttttgaccgcatactcccttagcaggggagcgccttcagcctctcggccacctcaccacacgcctcttacgagtgcttcgaagaacttgtttatcgctcatcgtcgctgcgtggcgcacatattactttctgagacttataagtcaaacaatttttcccacacttttatcgtttgcacacttcacgctcaattagtctgtaaaaacgtcaaaaagagtgttttatcaacagaaaaacggaggtctgacagatagcagtaatgcaaaaaaatggagacttaagttgaatgaacgggagtaaagcgaaaaaacaatggagtgaaagagaaattttgagggtgcgtctcaccgataaagatgagacgcggaaagattagtaactggactgctgggatttttcagcctggatacgctggtagatctcttcacggtgaacagaaacttccttcggggcatttacgccaatacgtacctggttgccctttacccctaaaactgtcacggtgacctcatccccaatcatgagggtctcaccaactcgacgagtcagaatcagcattctttgctccttgaaagattaaaagagtcgggtctctctgtatcccggcattatccatcatataacgccaaaaagtaagcaatgacaaacacattacatctaagcagtcatggcattacattctgttaaacctaagtttagccgatatacacaacttcaacctgactttatcgttgtcgatagcgttaatgcgaatgccgtgaagcgagtccacggcattgcctgacgcttatattattgcaatttcgcgctgacccagcctttcacactggctaacgctgcaggtaaggccgcagcatccgtaccaccggcttgcgccatgtcaggacgtccaccacccttgccacccacctgctgagcgaccataccaatcagttcccctgctttcacacgatctgtgacgtccttagatacgcctgcaatcagagaaaccttaccttcggctaccgttgccagcacgataattgtcgaccccagctgattttttaaatcgtcaaccatggtacgcaacattttcggctcaacaccgctaagctcgctaaccaacagcttaacaccattaacatcaattgccttactggaaagatttgcgctctcctgtgcggcagcttgttctttaagctgttgtaactctttttccagctgacgcgtacgttccagtactgaacgcactttatcagccagattattgctatcgcctttcagcagatgcgcgacttcgcttaagcgatcgctgtctgcatgaacggtggcgatagcgccttctccggtcaccgcttcgatacgacgaacgcctgcagcagtacccgattcagagatgatgcggaacagaccaatatcaccagtgcggctggcgtgagtaccgccacacagctcggtggagaaatcgcccatgctcagcacgcgtacgcgctcatcatacttctcgccaaacagcgccatcgcacctttagctttcgccgcttcgagatccatgatgttggtttcgatcggcaagttacggcgaatctgtgcgttcaccaggtcttcgaccgcacgaatctcttctggtttcatcgcttcgttgtgtgagaagtcgaagcgcagcactttgtcgttaaccagtgaacctttctgcgatacatgagtacccagaacctggcgcagcgcagcgtgcatcaggtgcgttgcggagtgattcagacgaatacgggcgcgacgagcctcatcaacatcagcctgcacagcgtcgcccactttcagagaacccgcagcaagtttaccgatgtggccaatcgcctggccgtatttctgcgtatcttccaccgcgaaggagaagttagcgcctttcagttcgcctttatcaccaacctgaccgccggattccgcatagaatggcgtttgatccagcacgactacagcttcctggcctgcattgatggcatcaaccgctttaccatcaacaaacagcgcggtcactttgccgttcagttccagatggtcatagcctttaaattcagatgcactgtcaacacggatcattgcgttgtaatcggcaccaaagccgctggcttcgcgcgcacgacgacgctgctcttccattgctgcttcaaaaccagcttcgtcaactttgatgttgcgctcacgacaaacatcagccgtcaggtcaaccgggaagccgtaggtgtcgtacaggcggaaagcagtttcaccatccagcgtatcaccagaaagttttgccagctcttcatccagcagcgccagaccgcgctccagagtacgggcaaactgctcttcttcagtcttcagcacctgctcaacctgcgcctgctggcgtttcaggtcttcacccgcagagcccataacgtcgatcagcggaccaaccagtttgtagaagaaggtttctttcgcgccgagcatattgccgtgacgcactgcgcgacgaatgatacgacgcagtacataaccacggttttcgttggacggcattacgccatccgcgatcaggaacgcacaagaacgaatgtggtcagcgattacgcgcagcgatttattgctcagatcggttgcgccagtgactttcgctaccgcctggatcagcgtgcggaacaggtcgatgtcatagttagagttaacgtgttgcagcaccgcagcaatacgctccagacccataccagtatctacagacggtttcggcagcggttccatcgtgccatcggcctggcggttgaactgcatgaagacgatgttccagatctcaatgtagcggtcgccgtcttcttccggacttcccggagggccgccccaaatgtggtcgccgtgatcgtagaagatttcggtgcacgggccgcacggaccagtgtcacccatctgccagaagttgtcagatgcgtatggcgcacctttgttatcgccgatgcgaataatacgttcgcgcgggatccctacttctttttcccagatttcgtaggcttcgtcgtcgctttcatagacggtaacccacagacgctctttcggcagggcaaaccatttttcgctggtcagcagttcccatgcaaactgaatggcatcgtgtttgaaatagtcgccgaagctgaagttgcccagcatttcgaagaaggtatgatgacgcgcggtgtaaccgacgttttccaggtcgttgtgtttaccacccgcacgcacgcagcgttgggaagtggtagcgcgggaataattacgcttgtcgagcccaaggaacacatccttgaactggttcatcccggcgttggtaaacaacaaagttgggtcgttatggggtaccagggagctgctggcaactacctgatgtcccttactatggaaaaagtcgagaaacgcctgacggatctcagcggtgctcttgctcataattatcctgaaatcaagctaacgaaatatcgctaccagccgttgcgtgtcgttaaccgcccggctggtaactgaaaagtgggaataagataagttttcttgactgggaagtaaaatcccgtatgcgttcagtcggcaaaatttcgccaaatatcctggatatcttccatcagatagccacgatagagcagaaaacgctggatcttaactttttctgaaaagacagttggcaaaggttcgccatattttcgcgtcgcctgatcgcgcgccagtgcgcaccagtcgatgtcacattcacgcatcgctttttctgtcgcttcgcgggaaatacctttctgattcagttcctggcgaatacgcgcaggtccataacctttgcggctacggctggcgataaagcgcgcaacaaatcggctgtcatcaagatagccatgttcatggcaccaggcaataacgcgctcgtaatcttctgccgtggcatcaatctcttccgggccatttttgcccataatcggtgccgcgagtttacgtcgcagttcttgctcactgtgatcgcgcaccgccagaatgcgtaccgcacgatccaacaggcgagcatatgccgggcgacgggatgttgattctgtcatggcatatccttacaacttaaaaaagcaaaagggccgcagatgcgacccttgtgtatcaaacaagacgattaaaaatcttcgttagtttctgctacgccttcgctgtcatctacagagaaatccggcgttgagttcgggttgctcagcagcaactcacgtactttcttctcgatctctttcgcggtttccgggttatctttcagccaggcagtcgcattcgctttaccctgaccgatcttctcacctttgtagctgtaccacgcgcctgctttctcgataagcttctctttcacgcccaggtcaaccagctcgccgtagaagttgataccttcgccgtagaggatctggaattcagcctgtttaaacggcgcagcgattttgttcttcaccactttcacgcgggtttcgctacccaccacgttttcgccctctttcaccgcgccgatacgacggatgtcgagacgaacagaggcgtagaatttcagcgcgttaccaccggtagtggtttccgggttaccgaacatcacaccaattttcatacggatctggttgatgaagatcagcagcgtgttggactgcttcaggttacccgccagcttacgcatcgcctggctcatcatacgtgccgcaaggcccatgtgagagtcgccgatttcgccttcgatttccgctttcggcgtcagtgccgccacggagtcaacgacgataacgtctactgcgccagaacgtgccagggcatcacagatttccagtgcctgctcgccggtatccggctgggagcacagcaggttgtcaatatcgacgcccagtttacgtgcgtagattgggtccagcgcgtgttcagcatcgataaacgcacaggttttaccttcgcgctgcgctgcggcgatcacctgcaacgtcagcgtggttttaccggaagattctggtccgtagatttcgacgatacggcccattggcagaccacctgccccaagcgcgatatccagtgaaagcgaaccggtagagatggtttccacatccatggaacggtcttcacccaggcgcatgatggagcctttaccaaattgtttctcaatctggcccagtgctgccgccaacgctttctgtttgttttcgtcgatagccatttttactcctgtcatgccgggtaataccggatagtcaatatgttctgttgaagcaattatactgtatgctcatacagtatcaagtgttttgtagaaattgttgccacaaggtctgcaatgcatacgcagtagcctgacgacgcaccgcatcacggtcaccgctgaaacattcccgccgggtaatgccttcaccacgggcagtggcaaaagcaaaccagacggtgcctacaggcttctcttcactgccgccatccggcccggcgataccactaatagacacggcgtaatcagcacgagccgctttcagtgcgcctatcgccatttccaccacgacaggttcgctcaccgcgccatgctgcgccagcgtctcttcgcgtacaccgatcatttgcgcttttgcttcgttactgtaggtgacaaatccgcgttcaaaccaggcggaactgccggcaatatcggtaatcactttcgctacccaaccgccggtacaagactcagcagttgttacggttgcgccacgggctttcagcgcctgcccaacctgttcgcttaactgcatcagttcactgtcagtcatcacaacctctgtcagtcaaaaatttatgccggacaagataacactttcgtcaggaagatggtgttggcgttgcaattttacgaggaggattcagaaaaaagctgattagccagagggaagcccacgcccccctcttacaaatagttactgtacgcgcgccagcgccacggcttgtcctaactgccagaccgccattgcgtaatgggtgctgtggttataacgggtaatggtgtagaagttcggcagaccgtaccagtactggtagccggtgccaacatccagacgcagcaggctggcttgttgatggttgcccagcggctgctgtggcgttaaacctgccgcggcaagctgcgaaatgctgtacctggttttgaagccatttggcaagcctggcgcctgaccgtttgccattaccgcgacctgatcgcctttcacccagccgtgcgctttgaaataattcgccacgctaccgatcgcatcaaccggatcccacaggttgatatgcccgtcgccgctgaaatctaccgcatattgtttgtaagacgacggcataaactgtccgtagcccatcgccccggcaaaggaacctttcagattgagcggatcgtcctgctcgtcgcgcgccatcagcaggaaggtttccagctcgccagaaaaatactccgcgcggcgtgggtagttaaatgacagcgttgccagcgcatcgaggatgcgagttttccccatcacgcgcccccagcgggtttcaacgccgataatcccgacgataatttccggcggtacaccatacacctgccacgcgcgattcaacgcatcttcatactgattccagaaaaccacaccgttctgcacgttgtccggcgtaataaattttttgcgataacgcagccatgcgccgttcggacctgatggcggtttcaccgatgtggttggtgcctggttatccatcagccgcagtaccgaatccagacgtttcgcctgggagagaatttcctgcaactgcagacgatcgaaaccgtgtttgttcaccattttgtcgatgaactgctgggcattcgggttattggcgaagtcaccgcccatctgcatcacattgtgctgcggctcaagcaggaagccgccagacggcgttccggtggtcgtttcagtctcagtaggttttggcttgctgctacaggcggcaagcaacacaaaaaggggaagcaatgttacataacgacgcttgaacatgaggggtccatttaacagattcaaccaggggcaagtatggtaaagcatcccgccccgcacaaggaagcggtagtcactgcccgatacggactttacataactcaactcattctcctcactaccttctttatacaaactttcaaaataaaatatttatctttcattttgcgatcaaaataacacttttaaatctttcaatctgattagattagattgccgtttggtaataaaacaataaatcctgaaggagagaacaatgatagaaaccattactcatggcgcagagtggttcatcgggctgttccagaaaggcggagaagtgtttaccgggatggtaaccggcattcttccgctgttaattagcctgctggttatcatgaacgcattgattaattttatcggtcagcatcgtattgaacgatttgctcaacgttgcgccggtaaccctgtttcccgttacctgctgctaccgtgcattggtacgtttgtcttttgtaacccgatgaccttaagtcttggtcgctttatgccggaaaagtacaaacccagctattacgcggcggcctcttatagctgccactcaatgaatggcctcttcccccatatcaaccctggcgaactgtttgtttatctcggcattgccagcggtctgacaacactgaatctgccacttggcccactggcggtgagctatctgctggttggtctggtcaccaacttcttccgcggctgggtaaccgatctgaccaccgccattttcgagaaaaagatgggcattcaacttgaacaaaaagttcgtctggcaggagcaacatcatgacacgcattcggatcgaaaaaggaacgggtggctggggcggcccgcttgagctggaagccacgccgggcaaaaaaatcgtctatatcaccgccggtacccggcctgcgattgttgacaaactggcacagcttactggctggcaagctatcgacggatttaaagaaggtgaacccgcggaggcggaaattggtgtcgcagtaatcgactgtggcggcacattacgctgcggcatctatccgaaacggcgtattcccaccattaatatccactcgacgggcaagtccggcccgctggcgcagtacattgtggaagatatttatgtctctggcgtaaaagaagaaaacatcactgtagtgggtgaggcgacaccacaaccctcttccgtgggccgtgactatgacaccagcaagaaaatcaccgaacaaagtgatggtttactggcgaaggtgggaatgggtatgggttctgccgttgccgtgctgttccagtctggccgtgacaccatcgacactgtattaaaaaccattctgccgtttatggcgttcgtctcggcgcttatcggcatcattatggcttctggccttggtgactggattgcccacggtcttgctccgctggcgagccatccactgggtctggtcatgctggcgctcatctgctccttcccgctgctttcacctttcctcggcccaggcgcagttatcgcacaggttatcggcgtattgattggcgtgcagattggtctcggcaatattccgccgcatctggctttacctgcactgtttgccatcaacgcgcaggcggcctgcgacttcatcccggtcggtttgtcgctggcggaagcccgtcaggacacggttcgcgtcggtgtcccttctgttctggtgagccgctttttaaccggcgcgccaactgtactgatcgcctggtttgtctccggttttatctatcaatagaggctgaaacatgaccgttatttatcagaccaccatcacccgtattggcgcgagtgccactgacgccctcagcgaccagatgctcatcacctttcgtgaaggcgcgcctgcggatctcgaagagtattgcttcattcattgccacggcgagttgaaaggtgcactccatcccggtttgcaattttctctcgggcggcatcgctatccggtgaccgccgttggcagcgtggcggaagacaaccttcgcgaactgggtcatgtcaccctgcgcttcgatggtttaagcgaagcggaatttccgggcactgtccatgtggcaggccctgtacccgacgatatcgcgccgggatcggttttgaagtttgaatctgttaaggagtaaaaaatgaatcaggttgccgttgtcatcggtggtgggcaaaccttaggcgcgttcctgtgccacggtctggctgccgaggggtatcgcgtggcggttgtcgatattcagagcgacaaagccgcaaatgtggcacaagaaattaacgccgaatatggtgaaggaacagcgtacggttttggtgctgacgccaccagcgagcaaagcgttctggcgctttctcgtggggtagatgaaatctttggtcgcgtggatttgctggtctacagcgccggaatagcaaaagcagcctttatcagcgacttccagctcggcgattttgaccgttcgctacaggtgaatctggtgggttatttcctgtgtgcccgtgaattttcgcgtttgatgatccgcgacgggattcagggtcgcattattcagatcaactcgaaatccggcaaagtgggcagcaaacacaactctggctacagcgccgccaaatttggtggcgtcgggctgactcaatcactggcgctggatctggcggagtacggcattacggtgcattcgctgatgctcggtaacctgctgaaatcgcctatgttccagtcgctattgccacaatacgcgaccaagctgggtatcaaaccggagcaagtcgagcagtattacatcgataaagtaccgctcaaacgcggctgcgattatcaggatgtgctgaatatgctgctgttctacgccagtcctaaggcgtcgtactgcactggtcagtcgatcaatgtcaccggcggtcaggtgatgttctgatcaacagcggagatcttttaaggatctccgcgcgactaatagaatgcctgatgcgctacgcttatcaggcctacaggacttccgccactacatttaaggagaagttatggtatccgcactcatcaccgtcgccgttatcgcctggtgtgcgcaactggccttaggcggttggcaaatttctcgttttaaccgtgccttcgacacgctatgccagcaagggagggttggcgtgggccgttccagcgggcgctttaaaccgcgggtcgtggtcgctattgcgctggacgatcagcagcgcatcgtcgacaccttgtttatgaaaggactgaccgtcttcgcccgaccgcaaaaaattcccgcaattaccggcatgcatgtgggtgatttacagcccgatgtgatctttccccatgatccactatcacagaatgctctatcattggcgcttaaactgaaacgtggataatttcgttgtgaatgttacttgcttgcgaagttatcattttgaaacctaaatcaggtaatcacgcccatgaaacctcgtcagcgtcaggccgccattctggagtatctacaaaagcagggtaaatgctcggttgaagaattggcgcaatactttgacaccacaggcacaaccattcgcaaagatctggtcattctggaacatgccggaaccgtcattcgtacttatggcggcgtggtgttgaacaaagaggaatccgatccgcctatcgatcataaaacgcttatcaacacccacaaaaaagagctgattgcagaagctgccgttggttttattcatgatggcgactcaataattcttgatgctggcagtaccgtgttgcagatggtgcccctgctctcgcgctttaataacatcacggtgatgaccaacagcctgcacatcgtcaatgcgctatccgaactggataacgaacaaactatactgatgccaggcggaacatttcgcaaaaaatcggcctcatttcacgggcaactggcagagaatgccttcgagcatttcaccttcgataaattgtttatgggcaccgacggcatcgatctcaatgcgggcgtaaccacctttaacgaggtctataccgtcagtaaggcgatgtgtaatgccgcgcgcgaagtgattttgatggctgactcatcgaagtttggtcgtaaaagccccaacgtggtttgtagtcttgaaagcgtcgataagctgattaccgacgcaggtatcgatccagcgtttcgtcaggcgctggaagaaaaagggatcgacgtgatcataaccggagagagcaatgagtgaagcactactgaacgcgggacgtcagacgttaatgctggagttgcaggaagcaagccatttaccggaacgtctgggcgatgatttcgttcgcgccgccaatatcatcctgcactgcgaaggcaaagtggtggtttcgggaattggcaaatcgggccacattggtaagaaaatcgccgcaacgcttgccagcaccggcacaccggctttttttgtccatccggcagaagcactgcacggcgatctggggatgattgaaagccgcgatgtgatgctgtttatctcttattccggtggcgcgaaggaactggatctcattattccgcgtctggaagacaaatctatcgctctgctggcaatgaccggaaaaccgacgtcaccgctgggcctggcggcgaaagcggtgctggatatctccgtagaacgcgaagcctgcccgatgcaccttgcgccgacctccagcaccgtgaataccctgatgatgggcgacgcgctggcgatggcggtcatgcaggcgcgcggatttaatgaagaagattttgcccgctcccacccagccggggcactgggcgctcgcttgctgaacaaagtgcatcatcttatgcgtcgtgacgatgccatcccgcaggtggcgttaaccgccagcgtgatggacgcgatgctggaacttagccgcaccggtttaggtctggtggcagtgtgcgatgatcaacgactggtgaaaggcgtctttaccgacggtgatttacgtcgctggctggttggcggcggcgcactcaccacgccagtcaatgaagcgatgacggtcggcggcaccacgttgcaatcgcaaagccgtgccatcgacgccaaagaaatcctgatgaaacgcaaaatcaccgccgcaccggtagtggatgaaaacggcaaactcaccggcgcaattaacctgcaggatttctatcaggccgggattatttaatccttcagccccagacgtttcgccagcctatgcaggttggcgacgtcggtttccagcatccgcgcacaggcggcccagttgtgatgattttgcgccagtgcctgacgaatggtttcacgctggaacgcttctgtcgcttcacgcaggttttgcttaacaacgggcaccgccgccacttctggcggcggcaacgtcacctcaggaaaagcaaaatgttgcgcctcaagaatcacttcatcgccgctgcgggttgctctcgccagcactaccgcccgatgaatagcatgttccagttcacgaacgttccccggaaaattgtagtgttgcagtaaatttcgcgctccggcacttaataccactcgggagagccccagccgcaaacgacactgctcgcagaaataccccgccagcagaatgacatcatcgccccgctcacgcagcggcggcactgaaagtggaaacacgctcaggcggtggaacaagtcagcgcgaaatcgccctgccagtacctcttcgcgtaagtcacggttagtcgccgccagcacgcgcacatcgacccgcaaactgcggtcatcgccaacgcgttgaatatcgccatactgcaacaccctcagcagcttggcctgcaatgccaacgacaactcgccgatctcatcgagaaacagcgtgccgttatccgccatttcaaacttcccgctgcggttactgatagcaccagtaaacgcccctttcacatgcccgaacaactcactttccgccacactttccggcagtgcggcacagttgagatagaccagcggattcaccgcccgtggcgaggcttcatgaatcgctttcgccaccagctccttaccggttcccgtctcaccgctaattaaaacgttgagatcggatgccgccacaatctcaatctcttttttcaattgcgtcatgcctggggacaaaccaatcatctgcgtctgtttcaccgcttcaaacgacgcggcatcgcctggcagcatattctggctttccagttgttcaatcagcaatgcattacttaacgctcccgccgccagcgcagcaatcagccgtagctcttcgttgctgaaaacatcgaactgatcgggctgcatcccgtcgagcgtcaaagcaccgatcaggttttgcccggcaaacaacggcaaaccaacgcaggcgtgaaccttcagactctcctgccctggaatcagaccgtcataaggatcgggcaattcgctgtctgcgggaaagcgcaccacatcacccgcgcgggcaatcgcttccagccgtggatgcccttccagcgcaaagcgcctaccgagtacatccttcgccagcccgtcgatggcaagcggaataaactgccgcgagtcgtaacgtagcaacgcagacgcatcgcactccagcacctgacgcagcgtggtgatcaggcgctgaaaacgatcctgatgaccaatcccacgctgcaattcgatggcgatattcgccagcacatcaacggaaaaactcatctttgcctcactgtcaatttgactatagatattgtcatatcgaccatttgattgatagtcattttgactactcattaatgagcataattttatttatatagtaaaaacaattagataaaaaactggcacgcaatctgcaatcagcaagacatctttttagaacacgctgaataaattgaggttgctatgtctattgtggtgaaaaataacattcattgggttggtcaacgtgactgggaagtgcgtgattttcacggtacagaatataaaacgctgcgcggcagcagctacaacagctacctcatccgcgaagaaaaaaacgtgctgatcgacaccgtcgaccataaattcagccgcgaatttgtgcagaacctgcgtaatgaaatcgatctggcggatatcgattacatcataattaaccatgctgaagaggaccacgccggggcgctgaccgaactgatggcacaaattcccgatacgccgatctactgtactgccaacgctatcgactcgataaatggtcatcaccatcatccggagtggaattttaatgtagtgaaaactggcgacacgctggatatcggcaacggcaaacaactcatttttgtcgaaacgccaatgctgcactggccggacagcatgatgacttacctgacaggcgacgcggtgctgttcagtaacgatgctttcggtcagcactactgcgacgagcatctgttcaacgatgaagtggatcagactgagcttttcgagcagtgccagcgttactacgccaatatcctgacgccgttcagccgcctggtaacgccgaaaattaccgagatcctgggctttaacttgccagtcgatatgatagcgacctctcacggcgtggtatggcgcgataacccgacgcaaattgtcgagctgtacctgaaatgggcggcggattatcaggaagacagaatcaccattttctacgacaccatgtcgaataacacccgcatgatggctgacgctatcgcccaggggattgcggaaaccgacccacgcgtggcggtgaaaattttcaacgtcgcccgaagcgataaaaacgaaatcctgaccaatgtcttccgctcaaaaggcgtactggtcggcacttctacgatgaataatgtgatgatgccgaaaatcgccgggctggtggaggagatgaccggattacgcttccgtaacaaacgcgccagcgctttcggctctcacggctggagcggcggtgcggtggatcgtctttccacgcgcctgcaggatgcgggtttcgaaatgtcgcttagcctgaaagccaaatggcgaccagaccaggacgctctggagttatgtcgtgaacacggtcgcgaaatcgcccgtcagtgggcgctcgcgccgctgccgcagagcacggtgaatacggtggttaaagaagaaacctctgccgccacgacggctgacctcggcccacggatgcaatgcagcgtctgccagtggatttacgatccggcaaaaggcgagccaatgcaggacgttgcgccaggaacgccgtggagtgaagtcccggataacttcctgtgcccggaatgctctctcggcaaagacgtctttgacgaactggcatcggaggcaaaatgagcaacggcattgtgatcattggttcgggcttcgccgcccgccaactggtgaaaaatattcgcaaacaggacgccagtattccattaactctgattgccgccgacagcatggatgagtacaacaaacctgacctcagccatgttatcagtcaggggcaacgtgccgacgaccttacccgccagacggcaggtgaatttgccgagcagtttaatctgcgcctgtttccgcacacctgggtaacggatatcgatgccgaagcccatgtggtgaaaagtcagaataatcagtggcaatacgacaagttagtgctggcaaccggtgccagcgcctttgtcccgccagtgcccgggcgtgagttaatgctgacgttaaatagtcagcaagagtatcgcgcctgtgaaacgcaactgcgggatgcccgacgcgtgttgattatcggcggtggtttgattggtagcgaactggcgatggatttttgtcgggcaggcaaaatggtcacgctaatcgacaacgctgccagtattctggcgtcgttaatgccaccggaagtaagcagccgcttgcagcatcggttgacggagatgggcgttcatctgctgttgaaatctcagttgcagggactagaaaaaacagattctggcattctggcaacgctggaccgccagcgctgcatcgaagtggatgcggtaattgccgccaccggactgcgcccggaaaccgccctggcacgacgcgccgggctgacgattaatcgcggcgtttgcgtcgatagttatctgcaaaccagtaatgccgatatttatgcgctgggcgattgcgcggaaattaacggtcaggtattgccgttcctccagccgattcaacttagcgcgatggtgctggcaaaaaatcttctcggcaataacacgccgctgaaactcccggcgatgctggtgaaaatcaaaacgccggaattaccgctgcatctggcaggcgaaacccagcgtcaggatttacgctggcaaattaataccgaacgccagggaatggtggcgcgcggcgttgacgatgctgaccagcttcgcgcctttgtggtcagtgaggatcggatgaaagaggcatttggattgttgaaaacgttgtcgatgtaggcgagctacagtgccccaaatgtcggatgcggcgctgacgcgtcttatacgacctacagggaacgcatgtgttgatcacataatacgtttatgtcgcattgcactgtcccaaaatgccggatgcgacgctggcgcgtcttatccgacctgcggggatgaatatgtaggccggataaggcgttcacgccgcatccggcaatggtgtccaaatgcagcacgttttatccgttctggacttcccccgccccccagcgcgccgcagcaataaccccctgccccagagacaatccaccatcgcccgccggtaaactctgcgggaagagcaacgtaaaatcagcaagataatgcgccagacgtgcacgcagcaaacggttatgaataactccgccgctaaataccagcgtagtgataccacgcatcgtggcctgctcacgcatcaacgcggccaaaccctgcgccagcgcatcatgaaacgcccacgcgcgttgattaaccggagcctgccagttcagccactgctgccagaaagtggcgagatccagttgattgtccaccagcggcatcgtcaccggatgcgtcacgccgtggcacgaagccgccagcgcctcgagggcgcaagccgcttcaccttcataacttaacgtggctggcgcacagcccagcgccgccgctacggcatcgaacaaacgtccacacgatgatgccagcggcgcgttaattccacgctcaatagcccgcgccagcacgctccagttttgctgttgcacacttgccgtttcagagcaattcggccactccggcacaaagcgcaggcactgcgccagcaggtttcgccacggctgctttgcagccaaatcgccccccggaagcgccaccgcgggcaagccgcccaggtgctggcattcacgatagttcacccgcaagcactcgcccccccataaagcgccgttctcccccataccaataccgtcgagcgtcaacgcaatgacatctccgccatccagaggccagaggtgttctgccagacacgccgctgcgtgggcatgatgatgcagcaccgtttgcgtcggcagattcatctcacgcgcccactggctggagacatagcccggatgcgcgtcatgcacaacgtattgcggagtgaaatcgtagatgttttgcatcaggcgtaacgcttcgcgccactgcatctggatgccatcgtcacttaaatcgcccagatgctgactcaacaccgcttgttcgccgcgcaccaggcagaaggtatttttcagatccgcgccgagacacagcacaggcggaacatttttaaagcccggaggcaaagccagcgcatccggcacatacccccgcgaacggcgcagcatttcgccgctttcgcgcaccaccgaatcatccatccgctgcacgatgtcgcggttatgtatcaagaatccgtcggcaatgccctgcaaatccgccagcgcctgttcgttgctgatagccggtggtttaccgctcaggttgccggaggtcatcaccagcgggcattgcagttcctgtaacagcaaatgctggagcgggttcgcaggcaacattaccccgacttcgttaaggtcaggggcgatatcatcacaaagctcaggtacatattttttatccaccagcacaatcggcgcggcgggcgtggtaagcaactggcgcgcagcatctggtaaaccgtcagccactggcaacatgaccgccagcggtttcgccgggcgatgtttgcgcgcccgaagtgtcgccaccgcgttactgttacgtgcatcgcaggcaagatgaaatccgccaatccctttgatggcgacaatgttgcccatttttaactgtgcgatagctgcctgtaatgccgcctcttgttctgcatgttcaccatgacttacccattcaagatgggggccacactccgggcaggccaccggctgggcgtggaagcgacgatcgagcgggtcacggtactctttgtcacaggccggacacagcggaaacgccgccatcacggtaaacgggcggtcgtaaggcatggcgcgaataatggtgaaacgcggaccacagtgagtacagttgataaacggataacgccagcgtcgttcgcctggggtattcatttcggcaagacaagcagggcaagtcgcggcatcgggaacaatttgcgtattcatgacgccacccgcgctctggcggatggtgaactcagtgggcagttgtgaccagataaacggctcacgctcgacgctatcaatacgcgccagtggcgggcagtgctgatgcaattgaacaagaaacgtttccggatcttccagcagccggacttctacgccatcgccgtcattacagacatcgccgtgaagatttaattgctgtgccagttgccagacaaacggacgaaaaccgacgccctgcactttgccacgaatacgcagttggacaccgcaagatgtgttttttgccattgagttattcccgccatcatgaattgcgtaacccgcccagccggacacgacagcgtcgcatccggcagtcacaggtcggcgatactgcccgcttcgtattctacgaatatttccgggaattcctttgatgccagaacagttctgtaagatttttagaacatcagcgccgtgcggcggcgtttttctgcgctcagttgttcaagtttattacgatcgacacaaatcagcgcatgggtcgggcaagccgccatacacgccgggccgtcttcacgatggttgcacaggtcgcatttattggcttcggctttgtcagcccgtacattcagccctgcgccgctgttgcgaatcaccggacgcaccaccacttccatcgcaccatacgggcaagccacaacgcaggttttgcaaccaatacaacgttcctgcatgacatgaacaaaccctttatcacggctgatagcaccattcgggcagacgttagcgcacggtgcatcttcacactgacggcaaactgtcgccgtggaaatgttcacacctttaatgacatggatacgcggtaaaaatgtttccggggtcagcgatgcacagtcctgattttcctgatgagaaaccacgcacgccacttcacaggtacgacaaccaatacatttactcgcgtcagcaatgatgaaacggttcatcaaattctccagcaatgacagttaatgcgccgatacattcacaaatcatgccagtttttaatttactgttatttaaggaaattaaattctgtactacaggaaaaacgatgtcatcgacactagtgacgatgacatgtgatgacagtatttatcgtagtaaggcagagagaatccgttttctaatgaatattttatcgttgccagtccacatctgggtacttttttccgacaagtcgttctggtggtataaaaaagtaattgccagtaacggggaggatttaatggaagcaaccgtgccggatacggcgtgaacaacgaccactttgtcagctatccatatgattgtattttgaggttcatcgcagattagcgatgaacctttattgaataatactatttcgactgaaataacaggtaaggatacaaaatgggttcatggggaatggaggctctcgaaagcgacgaagggctggatttgattaattgggtagaggaacaactgcaagatgattcgacctttgatgccgagtcaattgttcaacgcttaagccagcatgaagatttgttcggatttcagggagatgaagaatttctctacgataataatgttatcagtctcgttgaacttatcattcaaaaagcagccgggaaaaaaatcacatcgagtaaacaaattgatcaactcgacggttatcggctcacgtcgattttcagcaaaaaactccagggccgtttacaaacaatcgacgacacacatgagtggataatgctttttgaggggcgagcacgcgaaaaggcaaaagcatatctgattgagattactgataaattaagagtagtaaagacaacagcctgaatgacaaacaagggcgcgcaaaattaagaatctgcgccctttcaaagcccgacaggcgtagcgcatcaggcgatttagcgtctgccatcagtcaaagaaaccattccggcttaacgccaaatcgggctgaaagtgccttaatgtgggatatcgtcaaggatcgttgtccagacaagatctggctgaccagggatttagagccgatttcgttcttcaaatccgcataggtcagattatgttgatcaatcagcgtgcgaagtaacgccacaccaacaggcattgccgcaacggctttgtcgaactctgcaaacttttcgttgttgttttcatattctgcaatgcggctcgtcagaaagtcgataagtggattggtgtcatcttcttcaatcaaatattcgaccagttccagtgcttcacgataatcatcttctgagtcactgcctcccagaaaggggactgcattgaccagttctcttgttgctttaacagcgcgtacagcattagcagtcattctttgttctctctgtagtaacgtgtcagtttgtcatactcggcgtgattagttatgtgcttcacaaagaaccgcttattaacaaagtttatgtaggcaatcacccttaggttgttcccacctacatccagaacgtaccatttgttgcgatatttaaaattgtcgaggttgggaaacgccgttcgcatttcttctggcgtagaaaaatccgtttccttaataacccgatacaatgcctgaagagccagagcgtcgttaggatatttacgcgcagactcttcaaatggcgctttagaaatgatgtgcatttttaagttttaacttccttatagtaagtaaacagccacatctgcgagttctatccttatatgttcggaacactatagcttatcaaatccaagttcacaatatgtaaacacttgcgcacgatataattactacaaaaatcctcatagccactctgcaaaaagtcagttctgattcaccccatcaaacacatcaccctttattaaacaacgctgtgtcagcgccagatctttcgtttgcgggttacgtccggcgacaggtttaatgacgagtttacggttggaggtataggtaaaacgcgtgagtgcggggtagcttaacttgccaaaccagccgtgaacgcgctgccatttggcctcttttacctgatacaaactggttatccagcaaccggaatcaaactgcatatccagcaattgcgtgtgaccattgccttgtaaatcaagcaaatcatcaacgccagtttcgtttgcggtgtaaaaaccatcgacctggaaaacacacgggcgaccttgctgattaaaggtcatcaggatcaaaaacgaggaaggcgccagcccgtttcccgaaacacctcgccagataaccaaatcctgaatgccattacgatcgaggtcagcacggtaaaattgcgcattacccgccatattttgcagcacacccacaggcacaaaccaggatttaccggcacggtccttagcggttaatcgccagtaatcatcttcatttggcatcttctcaagcgttacgcctgcaacgcccacttttctaaaatgccagttttgatcggcatcataaggcatggtcaggagaggtttcagcgcccgcttttgcgcgtattcgctgtcactcattggcagatattcggtaaagctggtggcctgtgcaggcagcactaagctcaataaaaaagcgcacatccctgtcctgatgttcaattccctgaattccttactgaaaaactactcttcttccgccgctaactgcgcgaagccgccatttccttcccagccttctagccgctgatacaccgtttccaccgcatctttaatctgctgagtcatcgggtagtaaaagccgacgatatccggctggatgccaaggaaaatcacttcgccaatatcttctttcaactggtcgataagatagttcagcggcatgttatgggtagtcatcataaacatctcggcgatgtcagccgggtcgatgatgcggatctcgccagggtttagccccatatccgtggcgtcgacaataagcagccgtgtcgggcgcagttcgcgaatagcgacaatgtcgttttccggtgcgctaccgccgtcaatcactacccagttacctttcggcgcggcagcgcacttttccgccagtagcgggcctgcgccatcatcgcccatcatgctattgccaacacagagtaaaacgtcagtcacgcagtctcctcaccatcaaatagatggcgttttcctgatgaatatcatgcagcatacttaacagcattgtactccattccttctgctgcgaagtttgcgctgcccgggctttatcgaatgcgttggccagcatcggcacatggttaatgtcgatgacgatctcaccatatttcggcacgccttccattttacggcgggcttcgctgcccgcctccagagtggcaatccatgccagatattcatcccacgggcaggtaagcgccgcttccaggcaatcgataaccccaaggtggtgaccaatcgccaggctgtaatagaccacctgctgcgcctcggcgggcgtggcatcgttctcatcaatgaatttacggctcagttgactgaacaccaccttttcactcatcggatacgcgcctcttcaacaacatgattcagatggctgacaatctcgttcagacgcggatcgttttccgcttccagccagcgtgcaacctgttcttcgccctgccctaactgtgtcaggaagtcatcggcaatctgacgaccgtaacgataacccgccagtcggcgtgcttcgcgatccactttcacgcgcagcggctgcaccatatcgccatgcagaatctccgccggttgttcatcctgctcacccggcccacgggcgtgaattttctgctccagcaggccgagcgccatcgcaaagccgtacagcgtggcggcaggcgttggcgggcaccccggaatgtagacatccaccgggacgattttatccgtaccgccccacacgcagtagagatcgtggaagatcccgccgctgttaccgcaggcaccgtaggagatacagattttcgggtccggcgcggactgccacgcacgcagcgcaggggatcgcattgcacgggtgaccgcgccggtaaacagtaaaatatccgcatgacgcggtgacggaacaactttaatgccgaagcgttctgcatcgaacagcggcgaaagcgtggcgaaaatttcgatttcgcaaccgttacagccgccgcagtccacgcgataaacgtaggcagaacgtttgatttttttcagtaacgacgccttcatgctggcgatggattcatccaccgtcatcgggaccggaatgccgttggcgtcacgggggcctaataaattgctcatcagatggcctctttcatatggcgagtcagttcaatacggtcggacggcaccaggcatttctggcgcttacattccgggcaagtctcaaagctttcgcggtggttttccgcgcggctgtcgccgttgtgcttaagcagcgcaatggcgtagtcgatctctttctggacggcgaaaggacgattgcagacgcggcagttgcacagcgcgaagcgggactgttgcaggaagtcttctttcttccacaccgccagttcgtattcttgcgacagtttgatcgccgctgtcgggcagacttcttcgcagcgcccacagaagatgcagcgcccaaggtcaaactgccacgccagctcaccagtggcgaggtcggtttcaaccgttaaggcgtttgacgggcaggcattgacgcaagccgcacagccaatgcactgctgcgggttctgctctggcttaccacggaagtttttatcaaccgcaatcggctccagcggataagacgaagtcgccgtgccggttttgatgacttttttgataaaggtaaacatggcgattccttatttcagcggcgagtttttacgctcaatgctgtaacgctcgagttctttgtacggcaccactttgctcttcttcttacgtacatcgaccacggtcatgcggtcggtacaggagtagcaagggtccaggctaccgataatcaacggcgcatcggaaacggtgttaccgcgcagcatgtagcgcagggtcggccagttcgcgtaggtcgccgcacggcagcgccagcggtacagcttctggttgtcgccggtcatgctccagtggatatcgtcgccgcgcggcgcttcggcaaagcccagcgcgaaacggtgcggaatgtaggtaaagccttccaccatcagcgggccgcccggcaagttatccagaccgtaatcgagcatattcagcgcggtatagacttcgttgatacgcactttcagacgggaaataacgtcgcagccctgctcgctgtggacttccattggcagcaggccataaccaacaaacgggtgatcggcacgggtatcacgggcgtgaccgctggcacgaaccatcgggccaacgttactgaagtcgcgagcgatttccgggtccagacgaccaatgccgacggtgcgttgttccatgttcggtgtgctcagcagcacatccaccagctcctgcacttcacgacgcatctgttgtgccagctggcgggtctggatcatgtcgtctttcagcagatcgcgacgaatcccgccgatcaggttcaggccgtaggttttacgtgcaccggtaaggatctctgccattttcatggaggtttcacgcacgcggaagaactgcataaagccggagtcgaagccggtaaagtgacaggccaggccgagattgagcagatgcgagtgcaggcgttctacctccagcagaatggcgcggatcatctgcgcgcgttctggcacctgaatacccatcgcgttttccaccgacgtggtataggcggtgctgtgagcaaagccgcagatcccgcacacacggtcagagaggaaggtcacttcgttgtaacccatacgggtttccgccagtttttccatgccgcgatggacgtagaacaggcggtagtcggcgtcgataatgttttcaccatcgacgaacagacggaagtgacccggttcgtcagaagtgacgtgcagtggaccaatcggcacgacgttgtttttcttgtcgcccagttcgttgatgaactcgtaggtttcagcatcggtagtcggtgccggacgctgacgataatccatgctgtctttacgcagaggataaagttcatccggccagtcatccggcagcaccagacggcgttcatccggcagaccaaccggaatcaaaccgtacatatcgcgcacttcacgctcgccccacactgccgccggaacgcgcggcgtcacggaaggatactccggtttgttggcgtcaacttcgacgcgaaccgttacccaacacttggtgcccttctccatcgacagcacgtaataaacggcgtaatgaccattcagtttgcgttcgtcgttaccaaacaacaccgacagccagccaccctgcttgtagtagagaaactccaccacttccggcaggtagttcacctttacggtcacggtcagctgatctttggtctgccaggcgtggtccagcacgacgccaggaaatgcctcattcagcgcggcgagataatgttgacctaatttttcttcagacatgctcaaactctctttaatcacgccgccagcaaggagacgaacgctaaaaatgcaaagccaaacccggcccaggtaatgcgcggagtaatatcaagacgcagacgggccatgctgttttcgaacagcgcgataaccaggacgccaaccaccagtttgacgatggcaatcaccagcgccagcagcagcccaccgacggtgaaggtttccatttgtccccacggaataaacaccccgacgaacatctgcaacaccaccagctgtttcaggctgatgccccatttcatgacgccaaagccgctgccgctatactcagagagcggaccttcctgcaactcctgctcggcttccgccaggtcgaacggcagtttgcccatttcgataaaagtggcgaacgcacaggcacaaagcgccagcaccagcgggatgctctggctcagtggccagtgataaacggtgtcggtgatgttgctgatgttggtggaaccggcaacctgtgcggcgacccacagaccaagcagcagcatcggttcaaccaacacgccaagcatcgcttcacggctcgcgccgatagcggtaaacgggctaccagtatccagaccagaaatggcaaagaagaaacgcgcgatggcgaagagatacagtaaggtgatcaaatcgcccagttgcggcagcggagagccgacggtcaccaccggcagcgcagtggcgatagtcagcatgacgcccaccatcacatacggcgtcaggcggaacacccagccggaggcatccgggccaacgctctggcggcccagcagtttgataatgtcgcgatactcctgcaacacacccggcccacgacggttatgcagacgggcgcgcgctacgcgggtaataccggagagcagcggcgcaacggcaaatagcaccagcgcctgaattaacggatataaaacactcattctcaggctcctcgtgaaacaataatcaccaccagcaccgccagttcaaccagcgccatccggcggaacagcaacgcactcccctcgcactgccagcccggcaccagagacaccggattcagccatttgcgtagtttcagcaccggcgcaaacgcctgtttcaccggcatggcaaaaccgtgagcggtaatcaccattgatttttcatgatcgtagccgcacacccaggccgcaccgcgggaacgcgacggcaaacgatcgcctttgcaaatcgccataatgatgaatggcagcagcgggcaggcaatcagcagcaacgtgatcattggttgagaaacggtggtgttagcaggctccagcggcagaggtacagcagcagagagcatcggcagtagccacggcgcagcaacaccgccaattacgcagcaaatcgccagtgccactacgcttacgctcatcaggagcggcgcacaggtggcgttttcggcctctttggtacgcggcgcgccgaggaaagtaacgccataaactttcgccatacacatcaccgccagcgcaccggtaattgccagccccacggcgagcagcggcccgagaagacgggcaacaaacgcgccactattgctcagtttgaagaaggattgatagataacccattccccggcaaaaccgttcagcggcggcagcgcagccattgccatcagcccgactaacatggcgatggagataaccggcattttcttgccaataccaccgagtttttcgatatcgcgatgaccggtacggaaccagacgctccccgcaccaaggaacagtacgctcttgaacaggctatggttaagcagatggtacagaccaccaaccagaccaagggcaatcagcgccggttgttcgagcgcgatacccgttacgccagcgcccagccccagcaggataatgccgatattctccagggtgtggtaagccagcagacgttggatattatgttccatcagcgcatacagaccgccgacgaatgcggtgatcatgccgagtaccagcagtgcgatcccccaccacagcggtgcattaccgcccagcagtgacagagttaaaatgcccagcaggccaattttcatgactaccgtggaaaacagcgcggcagctggcgcagaggcgttagcatgtgcctgtggcacccagccgtgcagcggaataatcccggccagcaggccaaagccaatcacaccgagcagccagatatcggaaccgagcggcagctgttgcatacgcatatccagcaggcgcagatccagcgtaccgtaacgctgccacagcagccagcaggcaatcgccagcagcagagtgccaagacgccccagcgcaaaccacagtttgccctctttgctgttgctggtgaggaacaccgcacacagggccatgatttcggccattaccacgaacatgccgaggttgctggcgatgacggcacagacggcggcagccatcaacatattgatctgcaagccgttgcatttcacctgcgcgtggcgatgccagtcaatgttgtagaggctgacaaacagaccgcacagaccgagcgtaatcagccaaatcgcgttaagcggagagatttgcacatcgtagcttaccagcgacagcgcaccgctcacgccaaccgcgccagtcagcacagtgaagcccgcggctgccgtatacaggctacccaccgcgccgccaattccggctatccagccacttagcgctttttgaaaagaaaagagaaatgccagaacagcggcggcgacaaaccacgccacgccgctattgatcagggaaattgcgctcatttagcctctccactttgagcctgctgaaacaaggtgagatcgccaaagtccgtgttaaaagtcagctcacgcttacgtttgctgacgcgggcgatatcggtgttatccaccagatgcagggctttagtcgggcacatccgcacgcaggccggaccttgttcatcaaagctacaaaggtcacatttgacggcgatcgcgcgaatacctggcacccagtcaagcaatgtgctgacacgcgccggagcaggcggtgccggtggcgctttcggggtattggcgtttgccggaatatccagcggacggctgccggaaaattcaattgcgccaaacgggcaggcgataccacacagtttgcagcttacgcacagactttcattcaactgcacagcaccatcaacacgagtgatggcgttaaccgggcagaccaccgcgcagggtgcatcttcacagtgatgacagagctgcggcgcagattctttttcatttagcatcactcgcaggcgcggcattgattgcaggccgtgctggcgatgcgtctctgaacaggcagcctcacaagtgtggcagccgatacagagcgtggagtcagcaattacaaaacgattcaccaggcattcctcaggtgattgtcatttttgacgaaaacatgccgatgaaatgtcattttcgacactcatcgacacgcccatccccaaacaggcgtaacgcctgcaaaacgggcaaagcctcagctcatgctaccgggctttgtccctttaccagttggcttaaattcaccggcacattgttttcaatggcggtatataagctgtcgtaaacgccagcgattttttcgagatagtgttccagaacttgttcgcgatcgcggatgttgaccttgccatcaatcatgccgtcaatgctcaactgcgcctgcgcaatccgctgtttgtcttcgccatcttttgtttcgacgtaatactcgatggtgtggctgttaaagccatccgccagggtgacgtaaatgcgaaaatgttcaaaaaggacgaaacagagttctttgtccggcgcgcagctcatggcgtgatgcaggcgcgctttcgataacgtgatcccctgaaccagcgaattgcagtagatgtgccactggtcctgtaggcgacgatgccgctgtgcgatgtaatcggctttctcgcttatttcccaaatagtcattgtcaggttacccgtttaacagagatgccagctttaggcattttctgtgccaacttttaattcattgttattaaagcgatttctaagctaaagatgaatttcgtcgccgtgtcgacgtgtcatttcgacatcatcgacattattcaccgcagggataatcaacactggcacaattattgcttgtaactggcaatagttaatgggaggcgatatgcacgaaataaccctctgccaacgggcactggaattgatcgaacagcaggccgcaaaacacggcgcaaaacgcgtaactggggtctggctcaaaattggcgcattttcttgtgtcgaaaccagctctcttgccttttgttttgatctggtttgccgcggcagcgtggcggaaggttgtaaactgcacctcgaagaacaagaggccgaatgctggtgtgaaacatgccaacagtatgtgacgctactgacccagcgcgtccgccgctgtccactgtgtcatggtgacatgctacagattgtggcagacgacggtttacagattcggcggatagaaatagaccaggagtgagcgatgtgtacaacatgcggttgcggtgaaggcaacctctatattgagggtgatgaacataaccctcattccgcgtttcgtagcgcgccatttgccccggcggcacgcccgaagatgaaaatcaccggcattaaagcgcctgaatttacccccagccagactgaagaaggcgacctgcattacggtcatggcgaagcgggcactcacgcgccgggcatgagccagcgtcggatgctggaagtcgaaattgacgtgctggacaaaaataaccgtctggctgaacgcaaccgcgcgcgctttgctgcccgcaagcaactggtgctcaacctggtttccagccctggttccggtaaaaccaccctgctgacggaaaccttaatgcgcctgaaagacagcgttccgtgcgcggttattgaaggcgaccagcaaaccgtgaacgatgccgcgcgcattcgcgctaccggcacaccagcgattcaggtgaacaccggtaaaggctgccatcttgacgcacagatgattgccgacgccgcgccgcgcctgccactggatgataacggtattctgtttatcgaaaacgtcggtaacctcgtttgcccggccagcttcgatctcggtgaaaaacacaaagtggcggtgctttccgttaccgaaggtgaagacaaaccgctgaaatatccgcacatgtttgccgccgcctcgctgatgctgctcaacaaagttgacttgctgccgtatctcaatttcgacgttgagaagtgcatcgcctgcgcccgtgaagtcaatccagaaattgaaatcatccttatttccgccaccagcggcgaagggatggaccagtggctgaactggctggagacacagcgatgtgcataggcgttcccggccagatccgcaccattgacggcaaccaggcgaaagtcgacgtctgcggcattcagcgcgatgtcgatttaacgttagtcggcagctgcgatgaaaacggtcagccacgcgtgggccagtgggtactggttcacgttggctttgccatgagcgtaattaatgaagccgaagcacgcgacactctcgacgccttacaaaacatgtttgacgttgagccagatgtcggcgcgctgttgtatggcgaggaaaaataatgcgttttgttgatgaatatcgcgcgccggaacaggtaatgcagttaattgagcatctgcgcgaacgtgcttcacatctctcttacaccgccgaacgccctctgcggattatggaagtgtgtggcggtcatacccacgccatttttaaattcggcctcgaccagttgctaccggaaaacgttgagtttatccacggtccgggttgcccggtgtgcgtactgccaatgggtagaatcgacacctgcgtggagattgccagccatccggaagtcatcttctgtacctttggcgatgccatgcgcgtaccagggaaacaggggtcgctgttgcaggcaaaagcacgcggtgccgatgtgcgcatcgtttactcgccaatggatgcgttgaaactggcgcaggagaatccaacccgtaaagtggtattcttcggcttaggttttgaaaccaccatgccgaccaccgccatcactctgcaacaggcgaaagcccgcgatgtgcagaatttttacttcttctgccagcacattacgcttatcccgacactgcgcagtttgctggaacagccagataacggtatcgacgcgttcctcgcgccgggccacgtcagtatggttatcggcactgatgcctataattttatcgccagcgattttcatcgtccgctggtggtcgctggtttcgaaccccttgatctacttcaaggcgtggtgatgctggtggagcagaaaatagcggcccacagcaaggtagagaatcagtatcgtcgggtggtaccggatgccggtaacctgctggcgcaacaggcgattgccgatgtgttctgtgtcaacggcgacagtgaatggcgcggcttaggcgtgattgaatcttctggcgtgcacttaacaccagactatcaacgattcgatgccgaagcacatttccgcccggcaccgcagcaggtctgcgatgacccgcgtgcgcgttgtggcgaagtcttgacgggcaaatgtaagccgcatcaatgcccgctgtttggtaacacctgtaatcctcaaaccgcgtttggtgcgctgatggtttcctccgaaggagcgtgcgccgcgtggtatcagtatcgtcagcaggagagtgaagcgtgaataatatccaactcgcccacggtagcggcggccaggcgatgcagcaattaatcaacagcctgtttatggaagcctttgccaacccgtggctggcagagcaggaagatcaggcccgtcttgatttggcacagctggtagcggaaggcgaccgtctggcgttctccaccgacagttacgtcattgacccgctgttctttcctggcggtaatatcggcaagttggcgatttgcggcaccgcgaacgacgtagcggtcagtggcgctattccgcgttatctctcctgtggatttatccttgaagaaggattaccgatggagacgctgaaagccgttgtgaccagcatggcagaaaccgcccgcgcggcaggcattgccatcgttactggcgacactaaagtggtgcagcgcggcgcggcagataaactgtttatcaacaccgctggcatgggcgcaattccggcgaatattcactggggcgcacagacgctaaccgcaggcgatgttctgctggtgagtggaactctcggcgaccacggggcgactatccttaacctgcgtgagcaactggggctggatggcgaactggtcagcgactgcgcggtgctgacgccgctcatccagacgctgcgtgatattcccggtgtgaaggcactgcgtgacgccacccgtggtggagtgaacgcggtagttcatgagttcgcggcagcatgcggttgcggtattgaactttcagaagcggcactgccggttaaacctgccgtgcgcggcgtttgcgaactgctgggactggacgcccttaactttgccaacgaaggcaaactggtgatcgccgttgaacgcaacgcagcagagcaagtgctggcggcgttacattcccatccattgggaaaagatgcggcgctgattggcgaagtagtagaacgtaaaggtgttcgtcttgccggtctgtatggcgtgaaacgaaccctcgatctaccgcacgccgaaccgcttccgcgtatatgctaataaaattctaaatctcctatagttagtcaatgaccttttgcaccgctttgcggtgctttcctggaagaacaaaatgtcatatacaccgatgagtgatctcggacagcaagggttgttcgacatcactcggacactattgcagcagcccgatctggcctcgctgtgtgaggctctttcgcaactggtaaagcgttctgcgctcgccgacaacgcggctattgtgttgtggcaagcgcagactcaacgtgcgtcttattacgcatcgcgtgaaaaagacacccccattaaatatgaagacgaaactgttctggcacacggtccggtacgcagcattttgtcgcgccctgatacgctgcattgcagttacgaagaattttgtgaaacctggccgcagctggccacaggtgggctataccccaaatttggtcactattgcctgatgccactggcggcggaagggcatatttttggtggctgtgaatttattcgttatgacgatcgcccctggagcgaaaaagagttcaatcgtctgcaaacatttacgcagatcgtttctgtcgtcaccgaacaaatccagagccgcgtcgttaacaatgtcgactatgagttgttatgccgggaacgcgataacttccgcatcctggtcgccatcactaacgcggtgctttcccgcctggatatggacgaactggtcagcgaagtcgccaaagaaatccattactatttcgacattgacgatatcagcatcgtcttacgcagccaccgtaaaaacaaactcaacatctactccactcactatcttgataaacagcatcccgctcacgaacagagcgaagtcgatgaagccggaaccctcaccgaacgcgtcttcaaaagtaaagagatgctgttgattaatctccacgagcgggacgatttagccccctatgaacgcatgttgttcaacacctggggcaaccagattcaaaccttgtgcctgttaccgctgatgtctggcgacaccatgctgggcgtactgaaactggcgcaatgcgaagagaaagtctttaccactaccaatctgaatttactacgccagattgccgaacgtgtggcaatcgctgtcgataacgccctcgcctatcaggaaattcatcgtctgaaagaacggctggttgatgaaaacctcgccctgaccgagcagctcaacaatgttgatagtgaatttggcgagattattggccgcagcgaagccatgtacagcgtacttaaacaagttgaaatggtggcgcaaagtgacagtaccgttctgatcctcggtgaaactggtacaggtaaagagctgattgcccgcgcgatccataatctcagtgggcgtaataatcgccgcatggtcaaaatgaactgcgcggcgatgcctgccggattgctggaaagcgatctatttggtcatgagcgtggggcttttaccggtgccagcgctcagcgcattggtcgttttgaactggcggataaaagctcactattcctcgatgaagtgggcgatatgccgctggagttacagccgaagttgctgcgtgtattacaggaacaggagtttgaacgtctcggcagcaacaaaatcattcagacggacgtacgtttaattgccgcgactaaccgcgatctgaaaaaaatggtcgccgaccgagagttccgtagcgatctctattaccgtctgaacgtattcccgatccacctgccgccactacgcgagcgtccggaagatattccgctgctggcgaaagcctttaccttcaaaattgcccgtcgtctggggcgcaatatcgacagcattcctgccgagacgctgcgcatcctgagcaacatggaatggccgggcaacgtgcgtgagctggaaaacgtcattgagcgcgcggtattgctaacacgcggcaacgtgctgcagctgtcattgccagatattgctttaccagaacctgaaacgccgcctgccgcaacggttgtcgcccaggagggcgaagatgaatatcagttgattgttcgcgtgctgaaagaaacaaacggcgtggttgccgggcctaaaggcgctgcgcaacgtctggggctgaaacgcacgactctgctgtcacggatgaagcgactgggaattgataaatcggcattgatttaacagatgtggttatactcgatcaacattcaatgaaaggaggcagtatggcagtttcagcaagaaatcaattaaccggaacagttagcgcagtagcaatgggcgctgtgaatgatgaagtagaactgacgctggcaggtggtgcaaagctggtggcaattgttacacacagcagccagcaagcgctgggtctggcgaaagggaaagaagcgattgccctgattaaagccccgtgggtcacgctggcaacggaagactgtggactgaaattctctgctcgcaaccagtttgctggcagcgtgtcgacaatcaccgaaggcgcagtgaacgccactgtccatatcaaaacggatgcgggttttgaaattgtggcagtggtaacaaatgaaagtcaggatgaaatgaaactcaccactggctcgcgcgttattgcattgatcaaagcatcagccatcctgattgccaccaaagcgtaaacgccttatttgccggagagtatggctctccggcagatttatttctttggacgatatttttctggcaactccggcaccggacgcttgtcatcgatgagatgacgcacggttaagatcggatgacgccacagcattctcggcccggcccaacgcataatctgtttcatctcttcacgctttgcaggctggtaacagtgcaccggacactgcttacaggctggtttctcttcaccgaacacacatttatccagccgcttttgcgcgtaagcaaacaacgcctcgtaatgctccggctctgctgacgcctgcgggcatttcgcttgataaagatcgatcatttttttaatcgtcagtttttcacgagagatacgcttgccggacatgctgcctccatactcttaaggtgcatttatattacaacttaattttaaaggggactatggctctgaaggaggaggtttcttcaaccgacgaatttggcgatcttgtttcatcgtcatcacgcaaaagctgcaaagcagcatttttcgcggaaccgacatcaagaactcacctttcgcgtcttcccctgaaatgattaactccggtatcatgtgcgccttatgtgattacaacgaaaataaaaaccatcacactacatttaacatcagggagccggacttaaccccatgagtacaatagaaaatttcgacgcccatacgcccatgatgcagcagtatctcaagctgaaagcccagcatcccgagatcctgctgttttaccggatgggcgacttttatgaactgttttatgacgacgcaaaacgggcgtcgcaactgctggatatttcactgaccaaacgcggtgcttcagcgggagagccaatcccgatggcggggattccctaccatgcggtggaaaactacctcgccaaactggtgaatcagggcgaatccgtcgctatttgtgaacagattggcgatccggcgaccagcaaagggccggttgagcgcaaagttgtccgtatcgttacgccgggcaccatcagcgatgaagcgctgttgcaggaacgtcaggacaacctgctggcggctatctggcaggacagtaaagggttcggctacgcaacgctggatatcagttccggtcgttttcgcctgagcgaaccggcggaccgcgaaacgatggtggcagaactgcaacgtacgaatccagcggaattactgtatgcggaagatttcgccgagatgtcgctgattgaaggtcgccgcggcctgcgtcgtcgcccgctgtgggagtttgaaatcgacaccgctcgccagcaattgaacctgcaatttggcacccgagatctggtcggttttggtgtggagaacgcaccacgcggactttgtgctgccggttgtctgttgcagtatgcgaaagatacccaacgcacgaccctgccgcatattcgttctatcactatggaacgtcagcaggacagcatcattatggatgccgcgacgcgtcgtaacctggaaattactcagaacctggccggcggtgcggaaaatacgctggcttcagtgctcgactgcactgtaacgccgatgggcagccgtatgctgaaacgctggctgcatatgccagtgcgcgatacccgcgtgttgcttgagcgccagcaaactattggcgcattgcaggatttcaccgctgagctacagccggtactgcgtcaggtcggcgacctggaacgtattctggcgcgtctggcgttgcgtaccgctcgcccacgcgatctggcccgtatgcgtcacgctttccagcaactgccagagttgcgtgcgcagttagaaaatgtcgatagtgcaccggtacaagcgctgcgtgagaagatgggcgagtttgccgagctgcgcgatctgctggagcgagcaatcatcgacacaccaccggtgctggtacgcgacggtggtgttatcgcatcgggctataacgaagagctggatgagtggcgggcgctggctgacggcgcgaccgattatctggagcgtctggaagtccgcgagcgtgaacgtaccggcctggacacgctgaaagttggctttaacgcggtgcacggctattacattcaaatcagccgtgggcaaagccatctggcaccaatcaactacatgcgccgccagacgctgaaaaacgccgagcgttacattattccggagctgaaagagtacgaagataaagttctcacctcaaaaggcaaagcgctggcactggaaaaacagctttatgaagagctgttcgacctgttgctgccgcatctggaagcgttgcaacagagcgcgagcgcgctggcagaacttgatgtgctggttaacctggcggagcgggcctataccctgaactacacctgcccgacctttattgataaacctggcattcgtattaccgaaggtcgccatccagtggttgaacaagtactgaatgagccgtttatcgctaacccgctgaacctgtcgccgcagcgtcgcatgttgatcattaccggtccgaacatgggcggtaaaagtacctatatgcgccagaccgcgttgattgcgctgatggcgtatatcggcagctacgtaccggcgcaaaaagtcgagattggcccgattgaccgtatctttacccgcgtaggtgccgcggatgatctggcttccgggcgttcaacctttatggtggagatgaccgaaaccgccaatattttacataacgccaccgaatatagtctggtgttgatggatgagatcgggcgtggaacgtctacttacgatggtctgtcgctggcgtgggcatgtgcggaaaatctggcaaataagatcaaagcgttgacgctgtttgctacccactatttcgagctgacccagttaccggagaaaatggaaggcgtcgccaacgtgcatctcgatgcactggagcacggcgacaccattgcctttatgcatagcgtgcaggatggcgcagcgagcaaaagctacggcctggcggttgcagctctggcgggtgtgccaaaagaggttattaagcgcgcacggcaaaaactgcgtgagctggaaagcatttcgccgaacgccgctgctacgcaagtggatggtacacaaatgtctttgctgtccgtaccggaagaaacttcgcctgcggtcgaggcactggaaaacctcgacccggattcactgactccgcgtcaggcgctggaatggatttatcgcttgaagagtctggtgtaataataattcccgatagtcttttgctatcgggaatattaacaacaactgacgaatcaaataaaaataccctgtataataggaaagcttattttacagggtaaaaccatgccatctacacgctaccaaaaaatcaacgcccatcactatcgccatatatggaccgttggtgatattcatggtgactatcaattattacaatcccgcttacatcaactctctttttgccctgaaaccgacttacttatttcggtaggcgataacatcgatcgtgggcccgagagtcttaacgtgctgcgcctgttaaaccagccctggtttatctccgtcaaaggcaaccacgaagcgatggcgcttgatgcattcgaaactggcgatggaaatatgtggcttgccagcggtggtgactggtttttcgatttaaatgattcagagcaacaagaggcaatagatctgttgctgaaattccatcaccttccacatattattgaaatcactaacgacaccataaaatatgtcatcgcacatgcagattatccggggaaggagtatcagtttggcaaagaaatagcggagagcgaattactctggcctgttgatcgtgtgcagaaatcacttaatagcgaattacaaaaaataaacggtgccgacttctttatatttggtcatatgatgtttgataacattcagacgttcgctaaccagatttatatagataccggatcgccgaaaagcgggcggctgtcattttataaaataaagtagtctcatgcttcttctgtgaagcatgagtaacccggcgttattgcaggtcattattcatttttcgctaccagcaaagagagatccagcttcgccagcgcgcggctggcactctccggcagaccatcgtcagtaatgatctgatcaaactcgcttaatggtaacgccagccatgtcgccacctgtccatatttcgtcgcatcacagaccaaaactcgctggcggctggcactggcaatcgcccgtttcaccgtgactttatcttctgctggcgtagagatcccccgcacactccatgacgatgcagaaataaaagcctgatcaatcatcaggctacgcagcatggtcgcagcggcttccccaacacaggaacggttttcccgacacactgcgccgccagtgtgaataattgtgcaattactgttgtcgagcaagtagtccgcaataacgaagtcgttagtaaccactgtgagtggctccatgtgaatcagatgctgtgcaatcgctaacgtggtcgttcccgcatccagatagatacaacgtcccggctgaacaagacttgccgccagcttgccaatagccgctttttgcgtcattgccagcgcagtttttacctgatgagaaggttcatgcgccacccgtcccggagactggacgcccccggacaccagcacaacggctccctgctgctccagtttttgtaaatcccgacgaatggtcatatgtgacacattcattctgtccgttagttcagcaatactaacaatgcctttttcagctaccatctcaaggatgatttggcgacgctctacgggtatcaacttttgctccttcctttgtcctgctgacattctacgctatttgcctgcgaaacgtgtgcggcgcaactaacgcttagttcacataaaataacacacaatgttaatttttgtgaatcagctcaccatatcgttatctttccgcgcttatattcacaacatcaaacaaaatatcacttaaattaacaaggagagcagatgaaaacgggatcggagtttcatgtcggtatcgttggcttagggtcaatgggaatgggagcagcactgtcatgtgtccgcgcaggtctttctacctggggcgcagacctgaacagcaatgcctgcgctacgttgaaagaggctggtgcttgcggggtttctgataacgccgcgacgtttgccgaaaaactggacgctctgctggtgctggtggtcaatgcgacccaggttaaacaggtgctgtttggtgaaaaaggcgttgcacaacatctgaaacccggtacggcagtaatggtttcttccactatcgccagtgctgatgcgcaagaaattgctaccgctctggctggattcggtctggaaatgctggatgcgccggtttctggtggtgcggtaaaagccgctaacggtgaaatgactgtcatggcctccggtagcgatattgcctttgaacgactggcacccgtgctggaagccgttgccggaaaagtttatcgcatcggttcagaaccgggactgggttcgaccgtaaaaattatccaccagttgttagcgggcgtacatattgctgccggcgccgaagcgatggcgcttgcagcccgtgcggggatcccgctggatgtgatgtatgacgtcgtgaccaatgccgccggaaattcatggatgttcgaaaaccggatgcgtcatgtggtggatggcgattacaccccgcattcagccgtcgatatttttgttaaggatcttggtctggttgccgataccgccaaagccctgcacttcccgctgccattggcctcaacagcattgaatatgttcaccagcgccagtaacgcgggttacgggaaagaagacgatagcgcagttatcaagattttctctggcatcactctaccgggagcgaaatcatgatcaagattggcgttatcgccgatgattttaccggcgcgacggatatcgccagttttctggtggaaaacggtctaccaacggtacaaattaacggtgttccaacaggtaaaatgccggaagcaatcgacgcactggtgatcagcctgaaaacgcgctcctgtccggtgcttgaagccacacagcaatcgctggcggctctgagctggttgcaacagcaaggttgcaaacagatttatttcaaatactgctctactttcgacagtacggcgaaaggtaatatcggcccggttaccgatgcattaatggatgctctcgacacaccgtttacggtcttctctccggccctgccggtcaacggacgtacggtttatcaggggtatttgttcgtaatgaatcaactgctggccgaatccgggatgcgccatcacccggtaaatcccatgaccgacagctatcttccccgtctggttgaatcgcaatccacagggcgctgcggcgtcgtttcagcacatgttttcgaacaaggtgtgaaagccgttcgtcaggagctggctcgcttacagcaagagggctatcgctacgcggtgcttgatgcgctgaccgaacaccatctggaaattcagggggaagccttgcgcgatgccccactggtaacgggcggttctggtctggcgattggccttgcccggcagtgggcgcaagaaaacggtaaccaggctcgcaaagcagggcatccgctcgctgggcgcggcgtagtgctctccggttcatgctctcaaatgaccaaccgccaggtagcacattaccgtcaaattgcaccagcccgtgaagttgatgtggcacgctgcctctcaattgaaactctggccgcttatgcacacgaactggcagagtgggttctgggccaggaaagtgtacttgctccactggtttttgccaccgcaagcactgacgcattggcagcaattcaacagcaatacggtgcacaaaaagccagtcaggcagtagaaacactgttttctcaactagcggcgcggttagcagcggaaggcgtgacacgctttattgtcgcaggcggtgagacctccggcgtagtcacacagagcctaggaataaaagggtttcatattggcccaaccatttcccctggcgtgccgtgggtaaacgcactggataagcctgtctcactcgcccttaaatctggcaacttcggtgatgaagcctttttttcacgagcccaaagagagtttttatcatgagcgatttcgcaaaagtagagcagtctttgcgagaggagatgacgcggattgccagttcattctttcagcgcggctatgcaaccggttcggctggcaatctgtcgctgcttttacctgacgggaatttactggcgacaccgacaggttcatgcctgggcaatctcgatccgcagcggctttccaaagtcgccgcggatggcgaatggttaagtggtgacaaaccctcgaaagaggtgctctttcatctggcgctgtatcgcaacaatccgcgctgtaaagcggtggtgcatttgcacagcacatggtcgacggcgctttcctgccagcaagggctggacagcagcaacgttattcgtccgttcacaccatacgtggtgatgcggatgggaaatatcccgctggtgccttattaccgaccgggcgataaacgcatcgcacaggatctggcggaactggcagcagacaatcaggcttttttactggcaaatcatggcccagtggtttgcggtgaaagcctgcaagaagccgccaacaatatggaagagctggaggaaacggcaaagctgatttttattctcggtgaccgcccgatccgttatctgaccgcaggtgaaattgcggaattaaggagttaatgcaatgcctcgttttgcagctaatttatccatgatgttcaccgaagtgccttttattgaacgcttcgccgcagcgcgaaaagccgggttcgatgctgtggagtttctgtttccctatgactactccccccagcaaatccagcagcaactggtgcaaaaccatctgacactggcgctgttcaataccgctcccggagatattaatgcgggagaatggggattatccgcccttcccggacgtgagcacgaagcacgcgcagacatcgacctggcactggaatatgcattggcgctcaattgtgaacaagtccatgtgatggcaggcgtcgtgcccgctggcgaagatgctgaacggtaccgggcagtatttattgataatctccgctacgctgccgaccgctttgcgccacacggcaagcgaatattggttgaagcactcagccccggcgttaagcctcattatctcttctccagccagtatcaggcactggctattgttgaagaggttgcgcgagataacgtatttattcaactggatactttccatgcgcaaaaagtagatggcaacctgacacatttaatccgcgactacgccgggaaatatgcgcacgtacaaattgccggactacctgatcgacatgaaccggacgatggagaaatcaactatccgtggctgttccgcctgttcgatgaagtgggatatcagggctggatcggttgtgaatacaaacctcgtggcctcaccgaaaaagggcttggctggtttgacgcctggcgctaattcgctcaatccctaattacaacgtacccatacatccccccatctacggatggggtaggttaactataactttcagacagggtttcccatgtccacaattacattgttatgcattgcgttagctggcgtaatcatgctgttgctactggtcatcaaggaaaaggtacaaccattcgttgctctgctcctcgtcagcctgttagtcgcacttgcggcgggtataccggcgggcgaagtgggtaaagtgatgatcgccgggatgggcggtgtgcttggttccgtcactattattattggtctgggcgctatgctggggcgtatgatcgaacactctggtggtgcagagtcactggctaattatttcagtcgcaagctaggtgacaaacgaactatcgctgcgctgactctggcagcgttcttcctcggtattcccgtcttctttgatgtcggctttattattcttgcgccaatcatttacggttttgccaaggttgccaaaatatcaccactcaaatttggcctgcctgtcgctgggatcatgctcactgttcacgtggcggtaccgccgcatccaggccctgtcgccgcagcggggttactccacgcagacatcggctggctaaccatcatcggtattgcgatttctattcccgtagggattgttggctactttgcagcgaaaataatcaataagcgccaatatgcgatgtcggtcgaggtactggaacagatgcaactggctccggccagtgaggaaggcgcgacaaaattaagcgataaaataaatccaccgggcgtcgcgctggtcacctcgctaattgttattcctatcgcgattatcatggcgggtacggtttctgcaacactgatgccgccttcgcatcccctgcttggtacgctacagttgatcggctccccaatggtagctctaatgattgcgctggtgctggcattctggttattggctttacgtcgcggctggagcttacaacacaccagcgacattatgggctctgcccttcccactgcggcggtagtgattttggttactggtgctggaggggtatttggcaaagtgctggtggaatcgggcgtcggtaaagcccttgccaacatgttacaaatgattgacctgcctctgttaccagccgcatttattatttcactggcgctgcgtgcatcgcaggggtcagcaaccgtagcaatcctgacaaccggcgggttactctcagaagcggtgatgggattaaatccgattcagtgcgtattggtgacgctggcagcctgctttggtgggcttggcgcgtcacatattaatgactcagggttctggattgtgaccaaatatctggggttgtcggtagcagacggtctgaaaacctggacagtgttaacgaccattctcggttttaccggattcttaattacctggtgcgtatggctcgtcatctaataatccagataagatatgatgtatcgtttaagtgcctgataagggtgtaatgtatgccaatattaacctcggtaatatctcgctaccgaggttaattttcactttgcaatataattacagtctcttgcaagttgattttatcttagtaataagaaccgaccaatcttattgccatttcgatattagcaggcatagatgcgtcgtagccatacatatggccatatttcggacgtaatacttcagttactttcttaataattgcttcgcgctgggctcgcgcaaaatcagcatgattatttgccgttttattcataaatttaccaaaactttcttcttttctgactttaattgtcgtatcccgaagatcattaagaaactggcgttgaaatttaaaatcatcgtgtgaaccaatattaccatgcccgccaataaaatatttccagtcaagcatttcaacctgacgcaaattactgtcatggtaaaccaacgtatccgatacggcgaagcccatcatcggcagttggtcaggattcaggagatccgggctgtgagctactttttcctgttttagcaaccatacagaatggtcgtcggtatgtcctgctttaacaaatcggtgtaattcaatggtctgcttttcaaatttaaactggtcatcttttttacttaaaacctgagtggcgacgggtaagcgactgttcataaattgcattttttcagcagtggctttactggcaataatacgcagattcacgccttctttcttcgcctcatcgttccaaaatggactatcgccaatgtgatccacatggtaatgagaataaaccagcgctgttacgggtaatggagtcacatcacgaattgcctgtaataaatatttaccgcgaccctccggagcatcaaacagcaaaacccctttgtctccgacataaaacgtagtggaataaaaatagcgttgaacataataagttctctcgccaattttttgtaaaatataagactgagacatatttctttcaaaaaggttattgagtttatcgcttggcgatattattttttccgctgaaggctcaacataacttgcattaactgtagacgaatttgcagtcgaaatttccgtttgagcaaaaacactaccagatataagagaagaggctagaattgtatattttttaatgccttgcatacgtagtcctttattaatgtgttgttgatttatagcatctctgaacagactgttattttagatattactacgttacgagattcatttttcttcgaatattatgtttatctcattcaaaaaatatgttcatcatttgatggtttaaataatatctgcaaggcataatactccacatctttaaaacctgcctcaaaaaatcattcattagtaaaaaggatatttatatgcaaaacatagctgtggtttattattcaggatatggtcacactaaactggttgctgaaaaagtggcacaaggcgcccatgcagatttaatttcgattgataacgaaggaaatatcactgagcaggagtgggaaaaactggacgcagccgatgccattatcttcggtgctcccacctatatgggcggtgcgccatggcaattcaagaaatttgctgatgccatttccaaagcgtggtttacacgtaaatggcaggataaagtcttcgggggtttcaccaacagcgccagcctgaatggcgataaacaagttacgctgatctatctgcaaacgctggcttcacagcatggcggtctgtgggtgagtttaggtcaggctcctgccaatgtgcttgcgtcaaccagggaagatgtaaacaatctgggcggttcagtcggtttgctggtgcaatctccagccgatgcgggtgcagaccaaatccctacgggcgatctggatacagccgtgaaatatggtgaacgcgtggcgacaattactgcgcgcttaaaatgatgattgccgaatgtgacgctgacgcgtctatccggtcttctacatctaaaaagtgccgtcccctggtcagtcagataaagttttaacgctgtatccgataacagttcaacatgtaccaaaagaaaaaaagccagcctcgcttgagactggcctttctgacagatgcttacttactcgcggaacagcgcttcgatattcagcccctgcgtttgcaggatttcgcgcaaacggcgcaggccttcaacctgaatctggcgaacacgttcacgggtgaggccaatttcacgacctacatcttccagtgttgccgcttcgtaccccagcaaaccgaatcgacgtgccagcacttcacgctgtttggcgttcagctcgaacagccatttgacgatgctctgcttcatatcgtcatcttgcgtggtatcttccggaccattctctttttcatcggccaggatgtccagcaacgctttttcggaatcaccacccagcggggtgtctaccgaggtaatgcgctcgttaagacgaagcatacggctgacgtcatcaactggcttatccagttgctctgcgctctcttccgcacttggttcgtggtccagcttatgggacaactcacgtgcggttcgcaggtaaacgttcagctcctttacgatgtgaatcggcaaacgaatagtacgggtttggttcataatcgcccgttcgatcgtctggcgaatccaccaggttgcgtatgttgagaagcggaaaccacgttccgggtcaaacttctctaccgcgcggatcagccccaggttgccctcttcgatcaggtccagcaacgccagaccacgattgccataacggcgggcaatttttaccaccagacgcaagttactctcgatcatccggcggcgagaggcgacatctccacgcagtgcgcgacgcgcaaaataaacttcttcttcggccgttaacagtggtgaataaccaatctcaccaaggtaaagctgagtcgcgtccaacacacgctgtgtggctccctgcgataacagttcctcttcggccaaatcgttatcactgggttcctcttctactaaggccttttcgtcaaaaacctcaactccgttctcatcaaattccgcatcttcatttaaatcatgaactttcagcgtattctgactcataaggtggctcctacccgtgatcccttgacggaacattcaagcaaaagcctggttccgccgatttatcgctgcggcaaataacgcagcgggtttacggatttccccttgtaacgaatttcaaaatgcaagcgtgttgaactggttccggtgctacccatggttgctattttttgccccgccttcacttcttgttgttcccggaccagcattgtgtcgttatgggcgtaggcactcaggtaatcatcattatgtttgatgataatcagattaccgtagccgcgcagcgcgttaccggcataaacaacgcggccatccgcggtcgcgataattgcctgtcctttgctgcctgcgatatcaatccccttgttgcccccctcagaagcgccaaaggtttcgatcactttgccctcagtcggccagcgccaggtggagataggcgtactggttgatgtactgctgacagtcggctcggttgtgcttgctgttggtaccgttacaggcgctgtgaccgtggtcgcagttggcttgttgttcggcaacattttgttagcactctgttcacccgaagactcagaatacgtaattgtcggttgcgacgcaacagcaacggtggaattttgtgcaggcttgatcacaactccttgctctgctgcgtcggcctgggtaatggcatttccgcctgtgattggcgtaccggaagcattacccacctgtaaggtctgaccgacgttcagcgcgtatggtgcctgaatattgttgcgctgagcaaggtcacggaaatcgttgccagtaatccaggcgatatagaaaagcgtgtcgccttttttcacggtgtatgtactgccgctataactgcctttcggaatgttcccatactgacggttgtagacgattcgtccgttttccatctgtaccggctgctgagctactggctgcacaggctggatttgcggttgttgagtagcctgaatttgtggctgctgtaccggctgaatttgcggttgctgcgctgtagacgtcgtccccattttcggcggcggcgtaatcaacataccagaattggtatttgcgggcgcattgccattaacggagctgaccggtgccggtggatttgaagtgtcagaacagcctgccagccatagcgaaaccagtgacaatgccgcaatgcggcgaacggtgaattttgggcttcccgcgctcatttatcccccaggaaaaattggttaataaccagtgacataattaccgtgcaaggcaccatactgaacactggaaaagatgttcacgatacgctgacttgcggcaaaataaccaggaaaaatccaggtatttcctcacgttttaagccagctcacccttcactaaagggacaaagcgcacggcctccacggtatcgataataaattcgcctccccgacgacgcacccgttttaaatactggtgctcctcccctacgggtaagacgagaatcccgccttcgtccagctgcgtcattagcgcagttggaatttcaggcggtgccgccgtaacaatgatagcgtcaaacggcgcgcgtgcctgccaaccttgccatccatcgccatgacgggttgaaacattatgtaaatcaagatttttcaggcggcgacgcgcctgccactgcaagcctttaatccgttcaaccgagcaaacatgttggacaagatgcgccaggattgcagtttgatatcccgaaccagtgccaatttccagcacccgcgactgcggcgtcagctcgagtaattcggtcattcgcgccaccatatacggctgcgaaattgtctgcccctgacctatcggcaaggcgatattgtcccaggctttttgttcaaacgcttcatcaacgaatttttcacgcggcacggcggcaagtgcattcagcaccagctcatcctgaataccttgcgcacgtaattgatccagaagtgcttgtacgcgtctgcttaccattgcgtgccaactcccacgctgtttaaccagtctgaaaccacatcttgcgcgctatgcgcagttaaatccacatgcagcggcgtgatggaaacatagccctcatctaccgcagcaaaatcggtccccggaccggcatcacatttaccgcccggcgggccaatccagtacagcgtattgccgcgcggatcttgctgcgggatcacctgatctgccggatgtcgtgtaccgcagcgcgtcacgcgaatacctttgatttgatccaagggtaaatccggaacgttaatattaagaatacgcccggtgcgcagcggctctttacacagtgcgcgcaaaattgagcaggttaccgccgcggcagtgtcgtaatgtttatgcccgtcaagcgagacggcaagcgccggaaaacctaaatgacggccttccatcgcggccgctaccgtaccggaataaataacatcatcccccagattcggcccggcgttaattccggacacaacaatgtccgggcgcgggcgcatcagagcatttacgccaagatagacgcaatcggtcggggttcccatttgcacagcaatatcaccattttcaaaggtaaacgtgcgcagggaggattccagtgtcagagaattagaagcgccgctgcggttacgatcgggggcgaccacctgaacgtcagcaaactcacgcaaggctttcgccagcgtttgtataccgggtgcatgtaccccgtcatcattactcagcaatatgcgcataatcacctgttgtgttgataagttccctgacaacgctggttgcaaaacttcccgccggaagccagaaacggatttctacggtgacatcatcccaccagttccagcttaattgttgcggatacagcagcatcgctctgcgcgcggcttcaactttttcgcgcaccagtaaggtttgtaattcagtttcttcggcgacagctgcttgttcgaatgccagcgcttcacgctgagttccccactcgccactgcccggcaatacggcggttatcatcagcactttatcgttgacgcgacgctgtaattccgccagttcttcggtggttgcgacaaaccagctaccacgtccggctaattgtagcgcatcgccgtcaacaacttgattaacgtctgcttttttgaggcgttcagcaacaatctgattaaacaacgcactgcgggctgccgacaaccaaaaactccgtttattgcgatcgcgcaccggagtattggtttgcgcccagcgcagcgcaccctgcaagttgctaccgccaatcccaaaacgttgagcaccgaagtagttcggtacaccttttacgcaaatatcgatcagacgttgttcaacgtcatcgcgattgctcacttcgcgtagtaccagggtaaaggcgttacctttcagcgcccctaaacgcagcttgcgcttgtgccgcgcatactccagcacctggcagccttccagttgaaaggcgctcagatcgggcatctctttgcccggcacgcgagcgcataaccactgttccgtaacagcatgtttatctttttgcccagcgaagctgacttcacgggcatgaattttcaggaatttcgccagtgcatccgccacaaaacgggtattgcagccgtttttaaggattctaaccagaatatgctcaccttcaccatcaggctcaaagcccaaatcttccaccaccacaaagtcttccggattggctttcagcagcccggtaccttgcggtttaccgtggaggtaagtgagattatcaaactcaatcattttgttgccttaatgagtagcgccaccgcttcacaggcaatcccttccccacgtccggtaaatcccagtttttccgtagtagtggctttcacgttaacatcatccatatggcagccgagatcttcggcaataaacacgcgcatttgtggaatgtgcggcaacatcttcggtgcctgagcgatgatagtgacatcgacgttgccgagggcataacctttcgcctgaatacgacgccaggcttcgcgcaacagctcgcggctgtcggcacctttaaatgccggatcggtatccgggaacagcttgcctatatctcccagcgccgccgcgccaagcaatgcatcggtcaacgcatggagcgccacgtcgccatcagaatgcgccagcagccctttttcgtaaggaatgcgtacgccaccaatgataattgggccttcaccgccaaaggcgtgtacgtcaaaaccgtgtccaattcgcattatgtattctcctgatggatggttcgggtgaggtaaaattcggccagcgccaaatcctccgggcgcgttaccttgatgttatccgcgcggccttcaacaagttgcggatgaaaaccgcaatattccagcgccgaggcctcatcggtaatggtagcgccttcatttagagcgcgcgtcaggcagtcatgtaacagctcacgagggaaaaattgcggcgtcagcgcgtgccataagccgttgcgatcaacggtatgagcaatggcatttttgcccggttcggcacgtttcatcgtatcgcgcaccggcgcagcgaggatccctcccgtgcggctggtttcgctcaacgccaacaatcgcgcgaggtcatcctgatgcagacaaggacgagcggcgtcatgcaccaatacccactgcgcgtcgccagcggctttcagacctgccagcacggaatcggcacgctcttcaccaccatcaacaaccgtgattcgtggatgattcgccagaggaagttgtgcaaagcggctatcgccaggacttatggcaatgacgacacgtttcaccctgggatgcgccagcagcgcatgcaccgagtgttcaagaatggtttgattaccgattgagagatattgcttaggacattccgtttgcattcggcggccaaatccggccgccggaaccacggcgcaaacatccaaatgagtggttgccatgttaattcccgggctgatttatcgattattttgccccgcagactgtgcgcgctttgacgcgtcaggcaccagacgataaaacgtttcgcccggcctggtcatgctgagttcattacgcgcacgctcttcgagcgcctcctggccgccattgagatcgtcaatttcggcaaaaagctgatcgtttcgcgctttaagtttcgcgtttgtagcttgctgtgccgccacatcattattgacgcgagtatagtcatgtataccgttcttaccgaaccacagcgaatactgtagccagaccagaatagccagcaacagcagcgttagtttacccatcctgccccctgaaaaacggcatcttcatcccatgcatccgaagacgactctacatcctctgttggggataccgcgacaacgcgggcaaatgtaccacatttgtccattgttacgtatacccagggcgtgcagaacataatctcattattagttacggattgaattatgaacagaatagagaggaaagaacaattaacccagtagccacataaacagcgcaccaaacataatgccaaccgtcgccagagtgaaaacaatactgtagcgtagctttccgtccatcaatgaatgcagtgcaatccccaccaccactgcgacgggcatcagcgccagaaagaaaggccaggtgtagataaaaaagagcagcgtgttagagccataaatcaacatcggaattgccaacgcgcacagccacgataaaaaaccaaccacagcgcctggcagcgaccatgtggtgtcttcaacctcagtaaggccgtcgttatttgttaatgtaatgttgtggctgttacgcatatctgatcctgttactttgacgaaccgggcatgaaaacccggtggtgtctcaggatctgataatatcgttctgtctcaacagatctaataattgctgtaccaaatttgttactaattgttcaccattgagatgaatttctgccgattcaggcgcttcgtaaacggaatctattcccgtaaagttgcgcagttcaccggcacgcgctttcttatataaaccttttggatcgcgggcttcgcaaatcgccagcggcgtatcgacaaacacttcgataaagcgcccttctcctacgcgttcgcgaaccatctggcgttcggcgcggtgtggcgagataaatgcggtcagcaccaccagtccggcttcaaccatcaaattcgccacttcaccgacgcgacggatattctctttacggtcggcatcgctaaaaccgagatcgctgcataatccgtggcgaacgttgtcgccatccagcagatacgtactgacgccaagtttatgtaacgcctcctccagcgcccccgcgacggttgatttaccggaaccagagaggccggtaaaccacagcacaacaccacgatgaccgtggtgctgttcgcgttgttgcggagttactgggtggctatgccagacgacgttttcgtcatgcagagccattatttatctcccagtaaatcgcgcgcaccccaatgcgggaaatggcggcgaaccagggcattcaattccagttcgaatgcactgaattcagatggcgcagcagttgcctggctaactggttcgtgcaccataccggcacctacggtcacattactcaggcgatcgataaaaatcagcccaccggtaaccgggttttgctgataacgatctaacaccagtggctcgtcaaaggtgagatctaccaggccgatgccgttcagcggcaggttttcaacttcgcgttgggtaaggttattgatatcaacctgataacgaatgccatcaacacgagcacgcgtcttcttaccggcaattttgatgtcgtaactctggcccggggaaagcggctgttccgccatccataccacatccaccgacgcgctctgcacagccggtaacgcttcgtctgccgccagcagcagatcgccacggctgatgtcgatctcatccgtcagcaccagggtgatcgcttctccggcaaaggcttcttcgcgatcgccatcaaaggtcacgatccgcgcgacgtttgattccacaccagagggcagcactttgacacgttgcccgacttccacgcgaccggatgccagcgttccggcgtagccacgaaaatcgagattcggacggttaacgtactgcaccgggaagcgcattggctgagcatccaccactcgctggatctccacggtttccagcacttctagcagtgtcggaccgctgtaccacggcatactttcactttgcgaagccacgttgtcgccttccagtgcggagagcggcacaaagcggatatccagattacccggcagctgcccggcaaaagtcagataatcttcacgaatacgggtgaacgtctcttcactgtaatccaccagatccattttgttgatcgccacgaccagatgtttgatccccaacagtgtggagataaaactgtgacgacgggtttgatcgagcacgcctttacgggcatcgatcagtaagatcgccagttcacatgtcgatgctccagtcgccatattgcgggtgtactgctcgtgccctggggtgtcggcgataataaatttacgcttctcggtagagaaatagcggtaggccacatcaatagtgatgccctgttcgcgctcagcttgcaggccgtccaccagcagtgccagatccagcttttcgccctgggtgccgtgacgcttactgtcgttatgcagcgatgagagctgatcttcgtagatttggcgggtatcgtgtagcaggcgaccaatcagggtacttttgccgtcatcgacactaccacaggtcagaaaacgcagcaggcttttatgttgttgcgcaatcatccaggcttcgacgccgccttcattggcgatttgttgtgcaagtgcggtgttcatcttaaaaatacccctgacgttttttcagctccatagaccccgcctggtcgcggtcaattacgcggccctgacgttcactggtggtggaaaccagcatctcttcgatgatctccggcagtgtttgcgcatttgactccaccgcgccggtcagcggccaacagcccagtgtgcggaaacgcaccatccgttttttaatcacttcgcccggttgcaggtcgatacggttgtcatcaatcatcatcaacataccgtcgcgttccagaaccggacgttccgcagcaagatacagcggaacaatgtcgatattttccagccagatgtattgccagatatcctgctcggtccagttagagagcgggaagacgcggatgctttcgcctttgttaatttgcccgttgtagttgtgccacagctccgggcgctgatttttcggatcccagcgatggaagcggtcacggaaagagtagattcgctctttagcgcgggatttctcttcgtcacggcgcgcaccaccgaaggcggcatcaaaaccgtatttgttcagcgcctgtttcaggccttcagttttcataatatcggtatgtttcgcgctgccgtgtacgaatggattaatccccatcgccacgccttccgggtttttatgcaccagcagctcgcagccgtaggctttcgccgtacgatcgcggaactcatacatctcgcggaatttccagccggtatcgacatgcagcaacgggaaaggcagcgtacctggataaaacgccttgcgcgccagatgcagcatgacgctggaatctttaccgatagagtagagcatcaccggatttgagaattctgcagccacctcgcgaataatgtggatgctttccgcctccagttgccgcaggtgggtaagtcgtttttgatccataaccgttcctttgcaataccgctattttcttgccatcagatgtttcgactatagggagcgtaagagaacgaatgaaattaccaattagaatgagtagttccttaacggaataacgatttggcaaagctaatatcaaaaagtgcttaaggcaccggatttcgggcgtttaggaagatttgaaattgttttagcgcagcggcagtttcatactatggcggtaaaaaaatttgcatggtatttaaggactcactatgttttccgcattgcgccaccgtaccgctgccctggcgctcggcgtatgctttattctccccgtacacgcctcgtcacctaaacctggcgattttgctaatacccaggcacgacatattgctactttctttccgggacgcatgaccggaactcctgcagaaatgttatctgccgattatattcgtcaacagtttcagcaaatgggttatcgcagtgatattcggacatttaatagtcggtatatttataccgcccgcgataatcgcaagagctggcataacgtgacgggaagtacggtgattgccgctcatgaaggcaaagcgccgcagcagatcatcattatggcgcatctggatacttacgccccgctgagcgatgctgacgccgatgccaatctcggcgggctaacgttacaaggaatggatgataacgccgcaggtttaggtgtcatgctggaactggctgaacgcctgaaaaatacgcctaccgagtatggtattcgatttgtggcgaccagcggcgaagaggaaggaaaattaggcgctgagaatttactcaagcggatgagtgacaccgaaaagaaaaatacgctgctggtgattaatctcgataacttaattgttggcgataagctgtatttcaacagtggcgtaaacacacctgaagcagtaaggaaattaacgcgcgaccgggcgctggcaattgcccgcagccatggaattgccgccaccacaaatccaggtttgaataaaaactatccgaaaggcaccgggtgttgtaatgacgcagaaatattcgacaaagccggtattactgtactttcggtggaagcgactaactggaatcttggcaataaggatggttatcagcaacgcgcaaaaacagccgcattccctgcgggaaatagctggcatgacgtaagactggataatcaacagcatattgataaggcacttcctggaagaatagaacgtcgctgccgtgatgttatgcggataatgctaccgttggtgaaggagctggcgaaggcatcttaatgggtttgaaatgattactcccttgcctgcaggaaatcaatgccaccagaaacagagtataaaaaagggtgcaggagaccaaaccatcacaattcagtacgcggggttttaccccgcgtggtggctacttcttcgattcgtaagcgagaactgccttaaactccataccacgttctctgatactcaactcacacaacgagtcgcctaccatcaacgtgaatcccagtactgtacaacacagtacgatgattgccacaagggcatattttgtcagcatgtcttgcctccctgcaaagaagagactaacatccgaattgcttaggttcgaacgtaggcctcaggttgatagaaatatcgcctggggcttttgtccatctggaacctcgcgaatgcttaacgccagacagcttcaagcacccaatgccattctatacctgttaattctccctgcgacgttctcgtttaaatgccggaatgctgctcgcaaaataaaaacgcccccatcatttctgacagaggcgtttaatttatccggcaatatttacccttcgtgtaatccacattccctttttaagccaaagaaacgcgtttcttcttccgccatgccgggttcccatttacgggttgtatgggtatcgcccaccgataaatatccttcatcccataatgggtgatatttcaggccatgtttttgcaggtactgataaatagttcggttatcccagtcgataatcggcagcactttaaatacgccacgctgaattgccagcaccggtaaattggcgcggctgccggattgttcacggcgcaggccagcaaaccaggtttgcacattcagttctttcagcgcccggttcatcggttcgactttgttgatgtcattgtacttttcaatgccttcaacgccctgctcccacagtttgccgtagcgtgcttcctgccaggcggcgctttcggtagcacggtacactttcaggttgagcttgagtttatccgttaactcgtcaataaagcggtaggtttccgggaacagatagccggtatcggtgaggatcactggaatatccgggcgaatctgattcaccagatgcagactcaccgccgcctgaatgccaaagctggaagaaagtacatattcaccgggcagattatccagcgcccaggctacgcggccttcagcgtccagtttttccagttgggcgttagtttccgccagcgccagaatccggtctacctttggcagttcgttcagggcgtttagatcgagtttggacataagttcctcactgtttgccttgcctgatgcaacgcttacacatcttatcaggcctacaagaccgggctgatggttaatcccacaaatcgcgcgccggatcgagcaccgggcgaatgatgcccgcacgcaccgtaaagtcgccgaagccttcacccacttcgcgctctttcgcccagcgccctatcagttcatcaagcgacgccaggatttccggctcggtgatgttttctttatacatccgtgggatacgtgtcccaatgcggttgccgccaagatgcaggttgtagcgacccggcgctttccccaccagacccacttccgccagcatcgcgcgaccacaaccgttcgggcagcctgttacacgcatcacgatatgctcatcgctgacaccatgtttcgccattaaattatcgatgttgtcgataaaagacggcaggaaacgctccgcttccgccatcgccagcgggcaagtcgggaatgacacgcaggccattgagttttcacgctgcggcgtgacggcattcattaacccgctttctttggcgatcttctcgatcttcgctttctcgctttccggcacgccggcgatgatcagattctggttcgccgtaatgcggaaatcacctttgtggatcttcgcgatctccagcaagccggttttcagcggacgtcccggataatcaagaatgcgaccattttcgataaacagcgtcaggtgccagttatcatcaatgcccttaacccagccaatacgatcgccgcgtccggtaaactcatacgggcgaatcggctcgaatttgatccccgcgcgacgttcgacttccgctttaaatgtctcaacccccacccgctccagcgtgtatttggttttggcatttttacgatcggtacgattaccccagtcgcgctgagtcgtcacaacggcttccgctaccgccagcgtatgttccagcggtaaataaccaaactcactcgccgtgcgggcgtaggttttcttgttgccgtgttcaatggaaagcccaccgcccaccagcaggttaaagcccaccagcttgccgttttcggcgatcgccacgaagttcatgtcgttggcgtgcagatcgatatcgttctgcggcgggatcactaccgtggttttgaacttacgtggcaggtaggtctgaccaaggatcggctcttcatcagtagtggcgactttttcctgatcgagccagatctccgcatacgcgcgggtacgaggcagcagatgttcagaaattttcttcgcccattcatatgcttccgcatgcagctgcgactcgtaagggttcgaggtgcagagtacgttacggttcatgtcgttggcggtcgccagcgcatcaagaccgactgagtgcagcatctgatgcaccggtttgacgttctttttcaggatgccgtggaactggaatgtctggcggttggtcaggcgaatgctgccatagatggtgttttcaccggcaaatttgtcgatcgcctgccactgtttagtggtaatcaccccacccggcagacgacagcgaagcagcatcgcgtggcgcggctccagcttctgttcagcacgttcggcgcgaatgtcgcggtcatcctgctgatacatgccgtggaagcggatcagcaggaagttatcgcccttaaaaccgcctgtcagaccgtcgtttaaatcttccgcaatggtgccgcgcaggtagttgctttcaagcttcatgcgctcggcgtctgtcagttttccttcgaccactaaaggcccaggatgtttttcgctcattagtagacatctcgctgataacggcgctctacgcgcagctcacttaaaaattcatccgccgcttcggtgtccatgccaccaaattcggcaatcacttccagaagtgcctgctcaacgtctttcgccatgcgattagcgtcgccgcagacataaatgtgggcaccatcattgatccagcgccacagctctgcgccctgttcgcgcagtttgtcttgtacgtaaattttttctttttgatcgcgcgaccaggcgagatcgatgcgcgtcagcacgccttctttgacgtaacgctgccattccacctggtagaggaaatcttccgtaaagtgtgggttgccaaagaatagccagtttttacccggcgcttcgtcggcagcacgctgctgcataaaggcacggaacggcgcgatgccggtgccagggccaatcatgatcaccggggtttccggattggttggcaggcggaagttgtcgttatgttcgataaagacgcggacttcaccctcttcttccacacgatccgcgaggaagctggaggcaccaccggcacgggcacggccttccacgtcgtaacgcaccacaccaacggtaacgtgcacttcgttctcgacttccgcctgcgaggaggcgatggaatacaggcgcggtgtcagcgggcgcagcagattaatcagcgcttcggcatccagttgcgccggagagaaacgcaccatgtcgacaatcggcgtcgtcgcggcgtaatgctgtaacttcgctttatcgcccaccagcggcagcagcgtttcgctgcgggtaagcgtggcatagttctcaacaatgttggcggtgttgacggtcagttcgaagtgccactgtagcgcttcgttcagaggcaacgttttgccctcgacggtgacaggttcatcgcctttcagccacagcagttcgacaagttctttcaccagtgccggatcgttttgataccagacgcccagcgcgtcacccggctggtaacgcaggccagagtcacctaagtcaatttcaatgtgacgaacgtctttttcagagttacgcccggtaattttctggttaacagagaggctcgccaccagcggcgcgtctttgctatacgggctggtgtggatttcatttaccgtgccagtagcgacggattgcgaaggtgccgcgacaggcgcacgcgatttaagcgcatcaaccacgcgggcgcgccactcgctggcagcaggctggtattcaacgtcggcatcgacacggtcgagcaggcgttcaccgcccagttccgccagcttactgtcaaaatctttcccggactggcagaaaaattcataagagctatcgccgaggctaaacacggcaaacgcggtgttttccagcttttgcgcttttttggagaacaggaacttatgcagcgcgacggcttcttccggcggttccccttccccttgcgttgacgtcaccacgataagcagtttttcgctggcgatttgtttgaatttatagtcgcccgcgttcaccagcttaacgttcagttttgccgctaataaatcatcgcgtaatgcttcagcaacccgacgcgcattgccagtttgcgaggcggagataatagttatacccggcatttctgcggcgggcgctggcgtcgctgcaagcgcagcaggctgctggttgagcacgccccagaaatagccagaaacccaggcaagctgggtaggagttaaatcggtcgtggccgcctgaaggcgtgccagttgctccgggttcaacggaagcaacgcggaaggtgggacctgtgtcgtcatgcgttgttatgttccagtaagcaaagctgtttctgcgccctgtcagcgcccataaaacagaagagaaggtaaggttaacggggtaaacggtgtggattaaagacgggatagcgataactaataaccaaatcgactaacctgttttagcaatagtctttaacaacaaaatagattaaccaacccaatgaaaaacaaatgaatattgcccatcaataagataaatcagcgattttgcgcaacaaagtcgttttagataatgcgaaaaaacagcctttccggtactctacggcggttttatcgtcatgtagagaaattatgatgtccaccacgttatttaaagatttcaccttcgaagccgctcaccgcttgccgcacgtcccacaagggcataaatgtggtcgcctgcacgggcattcctttatggtgcgactggaaattaccggggaagtcgatccgcatacgggctggattatcgatttcgctgaactgaaagcggcgtttaaaccaacttatgagcgcctcgatcaccattatctcaatgatattccaggtctggaaaacccaaccagcgaagttttagcaaaatggatttgggatcaggttaaacccgttgtgccgctgttaagtgcggtgatggtaaaagaaacctgcaccgcaggttgtatctatcgcggcgaatgataagagtgtgtcggcggtcaatttcccttaagtaacgctatgttagggtgttgtgttctggatatctggggcatgacatggaagacgactgcgacattattattatcggtgccggtattgctggcaccgcttgcgcgttacgctgcgcgcgagcgggtttatccgttttgttactggaacgagcggagattcccggcagcaaaaatctttccggcgggcggctatacacccatgcgctcgcggaactcctcccgcaatttcacctgaccgcgcctcttgaacgacgcatcactcacgaaagtctttctctgttaacgccagatggcgcaacgacgttttccagcttactgcccggcggtgaatcctggagtgtattacgcgcacgattcgatccgtggctggttgccgaagccgaaaaagaaggtgtcgaatgcatccccggtgcgacggtagatgcactgtatgaagaaaacggcagggtgtgtggtgtcatttgtggtgacgatattcttcgcgcccgttatgtggtgctggcagaaggtgccaacagcgtcctggcggaacgccacgggttagtgactcgtcctgctggcgaagcgatggcattggggatcaaagaagtgctgacgctggaaccatccgctattgaagaacgttttcatctggagaataacgaaggcgcagcgttgttgttcagcggcgggatctgtgatgacttacccggcggcgcatttctttatactaatcaacaaacgctctcgttagggattgtttgcccgctctcctcccttacgcaaagtcgtgttccggcaagcgagctgctggctcgctttaaaacgcatccggcagtgcgcccgcttatcaaaaacacggaatcactggagtatggtgcgcatctggtgccagaaggtggcctgcgcagtatgccggtgcaatacgccggtaacggctggctgctggtgggcgatgcgttgcgcagttgcgtcaataccggaatttccgtgcgcggtatggatatggcgctaactggcgcgcaggcggcggcacaaacgctgataagcgcctgccagcaccgcgagccgcaaaatctgtttccgctttatcatcacaacgtagagcgcagcctgctgtgggatgttctacagcgttatcagcatgttccggcgcttttgcaacgccctggctggtatcgggtgtggtctgggttaatgcaggatatttcccgtgatttatgggatcaggggaatacacctgttccaccgctgcgccagttgctctggcgtcatttacgtcgtcacggcttgtggcatctgacgggcgatgttatcaggagtctgcgatgtctgtagcccgtaatctctggcgcgctgccgatgcgccgcacattgttccagctgactccgttgagcgccagacggcacaacggttgattaacgcctgtccagcaggtcttttttcgctcacacctgaaggtggcttacgtgttgattatcacggctgcctggagtgtggcacctgccgtttgctgtgcgacgaatcaacactacaacagtggcgctatccgccttccggattcggcatcacctaccgctttggataaataataaggataatttatgcccctcttacacctgctccgccagaatccggtgattgctgccgttaaagataatgccagcctgcaactggcaatcgactctgaatgccagtttatttccgtgttgtacggcaatatctgcaccattagtaatatcgttaaaaagattaagaacgccgggaaatatgcttttattcatgttgatttgctggaaggcgcgttaaataaagaagtggtgattcagtttttgaaactggtaaccgaggcggacggaattatcagtaccaaagcctcaatgctgaaagcagcaagagcggaaggttttttctgtattcatcgactgtttattgttgattcgattgcgtttcacaacattgataagcaagttgcgcaatcgaatccggattgtattgagatcctgccaggctgcatgcctaaagtgctgggctgggtgacggagaaaatccgccaaccgctgattgctggcgggctggtgtgcgatgaagaagatgcgcgtaatgcgattaacgcgggtgttgtggcgctttccaccacgaatactggggtctggacgttagcgaaaaaattgctttgacgggataatcgtaacaagttgaatttggtgtgatttgtaggctgcacgccacatccgacattcagcgcctgatgcgacgcttgacgcgtcttatcaggcctacaagtccccagcccagaaccatcggcaggatcatccggcagcacgttattggcaatctgcgtgaatggttgtcaccagtgcctccagcaccgctttccagtcatcaaccacgccaacatctgcctgtgaaaataccgccgcgctggcgtcatgattaatcgccaccacaaacttgctattgcgtacgcccgccattaacgctgctgcgccggaagcgccaacaacaatacacacctcaggtgccagcagatgtccggaaataccaatcactttttcggcatcaacgccaccgttcatcactcgtgcccgactgtagcccacttcggctcccatcttttctgccagcatagcgatttcctggttatctgcctctccgccctgccccaccaccagcacccgtctggcctcagctaatgggtcacgggtaacatttttcagattttcgacgctgataagccagtctggaagcgcgccggggacaatgttcagttgctgcatcccagagggcaacgtggcgtttttatctgctcccgcctgacgtgccagcgaaaggcatagcgggcgtttttctgtttgcaacgtcgccgttagcgcatttccccagtgagatttgcgcacgcttgcggttgatatatcgaatgaaatcacctgacagatactggcgccatgtacacgccaggccagtcgggtagccagttcatcgccaaacgcgcccggaggaaagaggacaacctccgcaggcgttcgttgccactgttccaccagcgcatccagcacctgttccgcaatcatcggctgtggttctatttgccagtgtgccagggtacaaccgctgaaatcctgcgccgccagccagctcgctattgcggcatggtcctgatttattgtcacaagtacgatattcatggctgcatcctttggcataaatagtactgccatagcttttgcgctttttctgctaccgtttgcccatcaatcagcgtcgctccgcgtcgttgctctggccttgccagttgcaggcactgtatcgctggcgcttccgcggcaacagtttcgcgggtaatctccgctttccccgccgccattcgctggcgcattcccggtactggcaaggccacttcaccacactgacgcacggcaatcaccgcaggcaagcgaacccggcaacagcgcagtccatgttcagtacgctgttcgagggtgataaacggcgcgtcgagagtaaagcgctccacctgggtgaagcagggccagaccagcatttccgccagcaaaaatggcgtttgcccattctgcccttcgctgctttggcagccagtaattatcagatccagcggattctggtactgccattcggcaatatggcgagcgacaaattccggcgcaaagcgcagatctgccgccgtctccagcaatacagcttcctcaaacccaagtgccatgagatagcgcagccagtgcaacgcccgttcatcccccatgctcaacgcggttaaagacatcggcgtaccgttttttctctgcgccaacagcagcgcggcggcagcctgttcatcggcaccgagtaaacttcgcagaagcgaaacatccggtccgctattaccctgagccgcctgccactctttttccgccagcattccggcatccggttcggctttaaacgctaacagaatgttcattcgcacctcctacatttcccgccgccaccagcgggagtgctttggtttctggtgcccatagccaggtcacaacaaaaccaaccaacaacactgccgccaggagcaataaggtggcttgcattccccactgcgccagcacccacggcagcaggccagtacttaccgccgcccccaaccgactcatggcggtggcaaaaccgacgcccagcgagcgaatgtcagtaggaaaactttccgcaggcaaaatgcccaccagattactgactgccgaaatggtggtgctgaagagaacaaaaagcagcagcgttaatgaactgccggaaggcaaacaggccattactaccagcgttgccgttagcagcaaaaaacttcccagtaaaaatctgcgatgcgctaacaagtgggtcaacactaaccctaataacgcgccaacaattaacaacgcattaagcatcaggctggcagtcagcgcatcttccagaccaatagtttgggcgatggtcggcaaccaggtataaatcacaaaccatgggattacgaggcagacaaagaagacgctgttaaacgccgtgcgccgccagtagcgcgaagagaacaaggttttgatgtgtttatgggtcgccgttgccacttcatcgcccagtaaaacatgcgggccaaaatagcgatgaacgatagcgtgagcttctgcaaaacgcccctggcgcagtagccagcgtggcgattccggcgtgccccaacgtagcagcgtaatcagcaaggctggtaacgccgctgatgccagcagccagcgccaggcctccgggctttcggaaataaagtgatgtccggcaatacttgccagcacatagcctacggtccacaccacactgaatgcgcccagcaaaataccgcgatggcggcgcggggaaaattcagccagcaaggtgtgaccgactgagtaatcgcctcccagaccaatgccgatcaaaatgcgcaatccaataagatgctctggcgtggtggcaaaaaattgcaagaacgaagcgagcgtaatcagcataaaactgaaggtgaagattttttgccgcccgatatggtcggagatccaccccaaaaccaggctgccaagaaacaaaccaagtaacgccgagccgccgatcattcccgccataaacggcgtcagttgcatggcgggcgtaagctgaataatggcgtaaccaataacgccgaggacataaccgtcggtcaggtgtgcgccgaaagtgagcgcagcaattcgacagtgaaaacggttaagcggtaaatcatccattcgcaccggtgaagtgttcatctttaccccttcattgtccggtaataagaacggcttctcgcctgagaagccgaaaaggcaacgccccgtcatcgcggaacgctgcctgacacattatttttcaatcggatagatagtacccgtgttcataatgtcattaggatcgaactgctttttcagcccttccagcaacgcccacgcgctgccgtgttccagtttgctccagtgaacgcgatgtttaccgataccgtggtggtgcaccatcgaaccgccgagacgaatggtttcttcgcagatgattttgttgagcggattgtggtacttgtcgatttcctcttccggcttacagtcaacgacgttgtagtcgtagacgaagtacatgttggtgccgttctgatagctatgagaggagtgaccgcccagcatggtgatgtcgtcggcgtgcgggaactcggtacgaatacggttaataacgctttcgtagatttcgtgaatgcagctccagcagccggacacttcggtggtaaagcccatgttgccggttttgaggatctgcacacgttcggcagccactttatccggtccccagttcaggttgttaaaccaggtttcgatcagcttgctgtccacgcgctggcattgcgggtaacgggcaacgatttccgcaatcccttcgcccgtcgccttcgcaatgcgagagttaccttcagccataaagatcagtacacatttaccgtcggcaaaatgggtgaagtgttgggtgccatcttcagcatcatacaaacgagcaatcgacggacgatacccttccaccatgatttcacgcaggatgttgaagccggttttcatctcttccaggatatagccgtagaagagattgttttccggcgtaaatttgaagattttcactgtgacttcagtgatatagcacagtgcaccttcgttgccgatgatgatatgacgaatgtccgggccagccgcgcgacgtggcacgtttttaatgcgtgtgatggtgccatctgccagtaccgcttccagaccaacgaccatatcctcgattgcgccgtagagtgtggaaaactgcccaatactgcgggtcgccaccaggccgcccatctgcgccagcggctttgactgcggagaatgccccgtggtgtaacctttttcacgcaacgcgttttccagcacctccagcggaacgccacattgcgccgtggcctgcatattctcaatatcaatattaatgatttgattcatggcggagccgtcgagcaccaccgagttttccacaacggtttccagcccaccttcggtggcggaagcaccggtacgtggcacaccgttaattttgtgcgcattcataaaattcagcacacgggatacttgttctgtggaaccgagttttacgaccgctgccggaattggcaaagtataaatgccatgaatatccggaaatttacgaaaacggtcaatactgttcttctttaatactgtttcatcggtaattacgcgatctgcaccaacaatttcctttagctggtcgacaatcgctacgcgagataaagacatagtaattccttcctgataataaaaatggaatagttattaataagagaaaacagaaaccaccgttatgaattagcgcactaaataaccgccatcaaccactaataaatgtccgttgacataattcgatgccggacttgcgaggaatacggctgcacccattaaatcctgagtatcaccccaacggtttgccggaatatgatcaagaacacgctggttagtttctggattactacgggtcgccagcgtaatatcggttgcataataaccaggagcaataccattcacctgaatattatattggcctaattcatcgcaataggctttggtgaatccggcaagagcatgtttagtggcagaataagcaggtgaccattgaccacctaagtaagagaacaatgaacagatattaatgattttaccgcttttctgcgggatcataatttttgccgcttcgtagcttaactcgaatgcggcggtcaggttcacgtcaatcatcgggtcccagtcggcacgaccaaagtccagcaccttattcagcttacaaataccggcattgttaaccagaatatctacggtaccgaagcgctcacagcaggcagcgataatcttctgcggcgcgccttctgcggtgatatccacctgcataaaatcaacttcgacaccctgtttttcaatcatttcctttgtttcgccgttatctttgacgaaactaggaataaagacatttgcgccagctttggccaacgccatggcaaatgcctggcctaaaccgctattcccgccggtaacaattgctgttttacctttcagggagaaaaaatccattgagaacgcattgagagattcgattgacatagttagctccaatttccgtaaggcaaaaaaaaagaaaggtaacttcccccgcgagagggaagttacctttctcattatctctggtaactggagataatttttagcataaggacataactgctaatgtgatcgtaatcacagtgtgatgttcgtattgtcaaataatttaaaaaagcagaagcgtgattactctcacacaacacctctgctttccatgttatttcttattgcaattactagagacctgagaaaagtaatccacctgaaagggcggcttacttttctcttttttttgtctattacaaatgggaatacgatatgcaacacaactcatatcgccgttggataaccctcgcgataattagttttagcggcggcgttagtttcgacctggcttatttacgttatatttatcaaattcccatggcaaaatttatgggattcagcaataccgagataggtttaataatgagtacctttggtattgcggccattattttctatgcccctagcggcgttattgccgataaattttcacatcgcaaaatgattacttccgcgatgatcattaccggattactgggtctgttaatggcaacatatccaccgctgtgggtaatgctctgtattcaggtcgcctttgcgataacgacgattttaatgctgtggtcggtgtcgattaaagccgcatcgttgctgggcgatcatagcgagcaagggaaaattatgggctggatggaagggctgcgcggcgtcggtgtaatgtcgctggcggtgtttaccatgtgggtcttttctcgctttgcaccggatgacagcgccagcctgaaaacggtcattattatctatagtgtggtttacattctgctgggcattttgtgttggttttttgttagcgataacaacaatctgcgcagtgccaataacgaagaaaaacagtcattccagcttagcgacatcctggccgttttgcgcatcagcaccacctggtattgcagcatggtgatttttggtgtcttcaccatctacgccattctgagttactccaccaactatctgaccgaaatgtacggcatgtcactggtggcggcgagctacatggggattgtgatcaacaaaatcttccgcgcgttatgcggcccacttggcggcattatcaccacctacagcaaagtgaaatcccctacccgcgtggtccaaatcctttccatcatcggtttgctggcattgacagccctgctcgtcacgaactctaacccgcaatcggtcgcgatggggattggcttgattttattactgggattcacctgttacgcctcacgcgggctgtattgggcctgccctggcgaagcgagaacaccgtcttacattatgggcaccacggtaggtatttgttcggtgattggatttctgccggatgtcttcgtttacccgattatcggctactggcaagacaccctgcccgctgcagaagcctaccgcaacatgtggctaatgggcatggcggcgcttggcatggtgatcatctttacctttttgctgttccaaaaaattcgtactgctgatagcgcccccgcaatggctagcagcaagtaagccaggaaaattacaggagaaaaatcatgtcgaaaaaatacatcatagggattgatggcggaagtcagagcacaaaagtggtgatgtacgatctggaaggtaatgtggtttgcgaaggcaaaggcttattgcagccgatgcacacgccagatgccgataccgcagaacatcctgacgacgatttatgggcatcactatgttttgccagtcacgatttgatgagccagtttgccggaaataaagaagatattgtcggcattggcctgggctcaatccgttgctgccgtgcgttattgaaagccgatggtacgccagccgcgccgttgattagctggcaggatgcacgcgttacacgcccttacgaacacactaatcctgacgtggcctatgtcacctctttttcgggttatctgacacatcgcttaaccggcgagtttaaagacaatatcgccaactattttggtcagtggccggtggattataagagctgggcatggagtgaaaatgccgcggtaatggaaaagtttaatatcccccgccagatgctttttgacgtgcaaatgccgggcactgttcttgggcatatcacaccacaagctgcgctggcgacacatttcccggctgggctgccggttgtttgtaccaccagtgataaaccggtagaagctctgggagccgggttactggatgatgaaacggcggtaatttctcttggcacctatatcgcgctgatgatgaacggcaaagcactaccgaaagatccggtcgcgtactggccgattatgtcttctattccgcaaacattgctgtatgaaggttacggtatccgcaaaggcatgtggacagtgagctggctgcgcgacatgttaggcgagtcgttaattcaggatgccaaagcacaggatctttcaccggaagatttgctcaacaaaaaagcgtcttgcgtgccacctggttgtaatgggctgatgacggtactggactggctgaccaatccgtgggaaccgtacaaacgcgggattatgatcggttttgattccagcatggattacgcatggatatatcgttcgatactggaaagcgtggcgctgacgctgaagaataattacgacaatatgtgtcatgaaatgaatcactttgcaaagcatgtgatcattactggcggcggttcgaacagcgatctgtttatgcagatttttgccgacgtgttcaaccttccggcacgccgaaacgccattaacggttgtgcaagtctgggggctgcgatcaatacggcggtaggtctggggctatacccggattacacaacggctgtcgataaaatggttcgcgtgaaagatatcttcataccgattgagagcaatgccaaacgctacgacgcgatgaataaaggcattttcaaagacctaaccaaacatactgatgtgatcctgaaaaaatcgtatgaagtgatgcatggggaattggggaatgcggattcgatccagagctggtcgaatgcgtaagtgaggaaggccgggcgggaaactgtccggcctgaacatacctgaatggttatccccgctggtgcggggaactctctaaacataacctattattaattaattattttttaagacagtcacaatctaccaactttacagtatcacacaaacaacacatccattatgttaaagagcacttaatccattgattaaaaagataaatatttacaatgactctattcaaactaaaatctaccaaactttaccgcaataattttcactccagcgaaaaattaacgccacagaatttgtagagaatgataatgattagtccagaatgggcaaaatggaggtttttcagagacgacaaagaatataaatgagtagaagtctttacagattccacccatttataacgcttataaatgtttaatcaggcaatattcaaatatttatgtgtctgcatcgacaaacgccagttgcgcgcaatgcaggtatcgatacataaacgcgtagcatcttccttctggctaattggctgaagtgcaatgactcgcggtttatcatcggtcagcgtcgccagcaattcatccagtgcttcaatatcacgtacgcgtcctactgggtgtttgatttcgttggctcgctccagggcttgtgacaacacttcatagccaccgcgcatatttagctttggtgatacggtaacccaggtattcggtgtgcagcgtacttcatgagtaccactggtttcgatctggcagctaaaaccgttcttttcgagcaggtcagtcagtggcagcaaatcatgaatgcaaggctcaccacccgtaatcaccacatgacgcgcggtgtatccctgacggccaatgacagccagcaaatcttcactgctcgccgccccccacttatcactctctttggtcttcgccagaatgctgaaaagggagacttcccgatcctcaagcttttcccaggtgtgtttggtgtcgcaccaggcacagccaaccggacatccctgtaaacgaataaaaatggcggggacgccggtaaagtaaccctcaccttgcagggtctggaacatctcgttaatcgggtactgcatagcattctctgtgaagtggataattgttaattattgcagatcctgccacaacaatcatgtcttattaacattctgttacaggcaggtttgatgcaaaaattggctcagatcattaagaataaaatgaagcggcgtattatgttttcaaggattaaatgaaagggatttaaacatgtttagaatattcatcgcgtttatatttattttcaatttatcaggttgcggttataacgatattcaaacctatgatgaacaggttaatgcctcctggtcagaagtattaaatcaatatcaacgtcgcaccgatcttattcctaatcttgtcgctagtattaaaggttactccagccatgaacaagaggtactagaagccgtaacattggcacgtagtcaggctaatcgcgccagtagcgatcttcagaaaactccgggagatgaacaaaaattacaagcctggcaacaggcgcaggcgcaggtgactcgcactctcgggcagttaacgattattagtgagcgttaccctcagttaaaggctcaagagctctatcaaaacttaatggtacagctcgaaggaagtgaaaatagaattgccgttgcgcgaggaagatatattaaagccattgaacaatataatgtcactatccgcaaattccccgctgtattaaccgcaaaggtcatggattacacaccaaagaaaaattatttgccggatgatgtcaccgcagtaagtaaagccccaacaatagattttagccagaatgctaatgctcattaagcggggacgttctatgcgaaattttatcttccttatggctttcttctgttcatctgtgtttgctacacaaattccagtacctgaatcacccaggtatgtgaatgacttaaccggcacattaacaaacagcgaagtaaacaccctgaccaaccagattaaagccctgacgcaaaaaaaccacgcacagttggtcgtgttagtggttgatacaacaggcgatgaaaccattgagcagtacgcaacgcgggtattcgatagctggaaaccgggtgataaagaccgtgatgatggcgttctactgttagtcgcctggcaggatcataccgtgcgtattgaaatcggttacgggctggaaggtattattacggatgcacagtccgggaaaattattcgcaacagtattattccggcatttaaaaaaggcgacctggctggtggtttacaaaaggggatcaacgatattgaaagtcgcctgacggggaataattcagcaacgataacaccgaccgatcaccctttgccctttagcggttggtgggctttattagtctgggcgataatactgacgtttatttctgccagaggatatatcaaaacgttgggagtaatttgcttcgcagccattgtactggcctttgttttacctatagcaggtttcagcggaagctggggagtactcacaacattactctgcttcgccacaccgtttctggcagttgccatcgcttttacccccttcggcaaaaaggttcgggattcgatgcgtgatgccaaccagccatcacgccatacaagaagcaattcttcctcccactattcatcatcgtcatcctcttcattcgacaatgacaattttagcggtggtggcggttcatctggtggcggtggcgcttccgggcgctggtaacaaaaggaattgatatgcgtatttttctcttacttctgatgctatgcggttttcaggtattcgctgaacgattgccttcagtgactgacttaaccgggacattaacgacagaagaacaaagtgttttaaatcaacaattacagactctcgagcagcaaaaccacttccaggtggccgtgttggttacgccgacaacagggggcaaaaacattaaacttgcagcctcgcagagatacggggtatatcactggaaacccgttggagagaagcgatatggcgaaggtatcttaattctcgtcgtttggccggaagggctggcgtcaatgaagattggacatggactggaacagatgttgccgccggaacaagctgcgcaaattgttcgttaccatatgcagccagaattcgaaaaaaacaatctctttgctggattaacggacggaattgaaagcatcgcacagtttacccatatcaaagcgaaccttagccctttggatgctttagccaatcatctgtttgctaatccgcaactttcgctgccatgccttgcctggacagtgctgatgatcgttgccatcattgtcctctggcgatttaccagccgtccaggacctggcatatggatgatatcaatgattacacctacggtctggtttttctgctttcaggacgatgtcatcattcggcgggtgtcggtcgtttgttttagtttatttttcgcagcaatctgctggcagcgtctcgcagtagtttttaatatgtgccgcgtatttcctatgatgctggccccaaaaaataaaaacgctaaagtgaaaaaacaaaagaagactccgcaatttcgtgaatcaggacgaaattcattgtttgtcgtgatgctgataattattgtgggatggtgcctggtgttcgccagtaataaagatattgcattcatctcaacaattattgggttaattgatcattttatcggcccaataaccattgctggcatcgttctgctgatcattgtggccaaatttactggcaatcttaagctggggtcaggagaaaaaagcaacaggaaaacggggaatcgtaatgctcattctcgctcttcgtcgagaaattctttccgcggtggtggcggttcttcaggaggcggcggttcatccgaccgttggtgatcgtaatgcgcttaatctttattctattcactttgtggtgccttcctgggcttgcccagcaaattgctgtgccggaactgcgccaacaggtgaccgatattactggtacgttaagcacttctgaacaacaatcactgacacagcaactgcaggatattacacataaaacacgggcgcaggtcgctgtattagtagtgccgtccaccggagacgattccattgaacaatatgctacaagggtttttgacaattggcgtttaggagatgccaaacgtaatgatgggatactgatcattgttgcctggtcggatcgtactgtccgcatccaggtaggttatgggctggaagaaaaggtaaccgatgctctggctggcaatatcatccgtagcatcatgatacccacctttaaaaaacaaaaattagctaagggattagagttagctataatcgctttgaataaccaactcacttcacaacaccaatattcgtctaatccttcagaaagtgaatcagcgtcttccagtgatcattactactttgctattttttgggtatttgcagtgatgttcttccctttctggttttttcatcaaggcaataatttttgtcgggcatttaaaagcagtgtttgtatttcaacagtctatcttatagatttattcctgttctccgatcaaactttttccattgctgtattttccttcttttttgctttcaccatcattatggtctttacctggttatgtgtcccacagaaaaaagcatcaggtagaagttatcattcagacagcggcagttctggtggcggctcaagtggcggcggatttagcggaggtggcggttcttctggcggtggcggcgcgtctggccgctggtaactcagccataaaaaatgccagcccgaaggctggcatttttaaatcagataaagtcagacttatgcctggcctttgatctctttacgaccgttgtacggtgctttttcgcccagagcttcttcgatacgaatcagctggttgtatttagcaacacggtcagaacggctcatggaacccgttttgatctggcctgcagcagtaccaacagccaggtcagcgatggtagcatcttcagtttcaccagaacggtgagagataactgcagtgtagccagcgtctttcgccatcttaatagcagccagggtttcggtcagagaaccgatctggttgaatttgatcaggatggagttagcgatgcctttttcgataccttctttcaggatcttggtgttggttacgaacaggtcgtcaccaaccagctggattttgtcgcccagaactttggtctggtatgcgaaaccgtcccagtcagattcgtccagaccgtcttcgatggaaacgatcgggtactgtttggtcagttcttccaggaagtgagtgaattcttcagaggtgaatgctttgttgccttcgccagccagaacgtatttaccgtctttgtagaattcagaagctgcgcagtccatcgccagagtgatgtctttgcccagttcatagccagcagctttaacagcttcagcgataacagccagagcttcagcgttggaacccaggttcggcgcatagccaccttcgtcaccaacagcagtgttcatgcctttcgctttcagaacttttgccaggtgatggaaaacttcagaacccatgcggatggcttctttcacagttttcgcgccaaccggctgaatcatgaattcctggatatcaacgttgttgtcagcgtgctcaccaccgttgatgatgttcatcatcggaaccggcatagagtatttgcccggagtgccgttcagttcagcgatgtgctcgtacagcggcatacctttagcagctgcagcagctttggcgttagccagagatacagccaggattgcgttcgcgccgaatttggatttgttttcggtgccgtccaggtcgatcatgatcttgtcaatgccagcctgatctttagcatctttgccaatcagcgcctgagcgatcgggccgtttaccgcagcaacagctttggttacgcctttacccaggaaacgggatttgtcgccatcgcgcagttccagagcttcacgggaaccagtagaagcacctgacggagcagctgccataccgacgaaaccaccctccagatgtacttcggcttcaacagtcgggttaccacgggagtcgatgatttcacgaccgatgatttttacgattttggacattaggttttcctcaagtcactagttaaactgaaactccagacaaacaacgcgtacccagggtacgcgttgccgttctaacttttttacttacttcgcctgacgtttctggaactcgctggcggctttcacaaagcctgcaaacagcgggtgaccatcacgtggagtagaagtaaactccggatggaactggcaagccacgaaccacggatgattcggaacttcgatgatctcgaccaactgatcatccccggaacggcccgcaacgcgcagacctgcatcttcaatctgtttcaacagcatgttgttgacttcgtaacggtgacgatgacgctcaacaattgtcggcgcattgtacagctggcgaaccaggctatcgtcaaccaactggcactgctgtgcgccgagacgcatggtaccgccgagatcgctcttctcgctacgaacttcaacgttgccgttttcatcgcgccactcggtaatcagcgccacaaccgggtacttacagtctggcacaaattccgtagagttggcgttctccatgttggcaacatggcgagcgtaatcaattaacgccacctgcatacccaggcaaatgcccagataaggaatattgttctcacgcgcaaaacgcgcggtcgtaatcatgccttctacgccacgatagccgaaaccgccaggtacgaggattgcgtccagacctttgaggatttcaacgccgcgcgtttcaacatcttgtgaatcgatcagtttgatgttgacgctgacacgattcttcagcccaccgtgtttcagtgcttcgatcacggatttgtatgcatccggcagctcaatgtatttgccgaccataccaatggtgacttcacttaccggattcgcttcttcgaagataacctgttcccattcggacagattcgcttccgggcagtttaagctgaatcgtttacaaatataatcgtccagcccctgagatttcaacaggcccggaattttatagatggaatcgacgtctttcagagaaataaccgctttttccggaacattacagaacaatgcaatcttcgcacgttcgttcgccggaacggcgcgatctgaacgacaaatcaggatatcaggctggataccgattgaaagcagctcttttacagagtgctgagtcggtttggttttgacttcaccagacgctgccatgtacggcaccagcgtcaggtgcataaacagggtgtgctcacggccaatttcaacagccatctggcgaatcgcttcgaggaacggcagggattcgatatcacctacagtaccgccgatttcgaccagtactacgtcatgaccttcgccgccttccagcacgcgctctttgatagcgttagtgatgtgcggaataacctgtacggttgcgccgagatagtcaccgcggcgttctttacgcagaacgtcagagtagatacgacccgtggtgaagttgttgcggcggctcattttggtacgaatgaaacgctcgtagtgccccaggtccaagtcggtttcagcgccgtcttcagtaacgaacacttccccgtgttggattgggctcatagtacctggatcgacgttgatgtacggatccagtttcatgatggtcacattgaggccacgggcttcaagaatggctgcgagggaggctgcggcaatgcctttacccagagaggatacgaccccgccggtcacaaaaatatagttcgttgtcatgctgaacctgagaagttaggttgaaaagacgatggaataaccaggacgggaaagcagtatacccgaacatgacctgtgccacaaactttcattatccctcctcttcgccagcgcactattgaaatcaggagtgagaaaatagcccctttggggtaaatgtttttgacgcaaatcaagcgcttgtcatttaaaaaatgacacaaatcgcgcttgaccacgtaattcccttagagatcaatttcctgccgttttacctgttgccagacttcttccattgtttcgaggtcaacacctgtcatttccagtccacgcgcggcaacaatacgctccacttcgcgaaaacgacgctcgaatttttcgttcgctttttgcaatgcgatttccgcttttgtccctaaatgacgagccagattgaccgtggcaaacagcaggtcacccatttcctcctccagtttagcctggtcgacaacagcctgccgcgcctcgtacatcacctcgtcgatctcttcgtagactttatctactaccggaccaagcgtcgtccagtcgaaaccaacgttggcgcaacgtttctggattttttgcgcacgcattaaagccggtaaactacgaggaatatcgtccagcgccgaatgctgcgctttctgcgcgcgctcttcggttttgatttgctcccaacgggcaagcacttcactactattttcggcagaactgtcagcaaaaacatgcggatggcgacgctctaatttatcgctaatagcagcgcaaatatcattaaagtcaaagcgcccttcttcctgagccatttgtgcgtaaaacaccacctggaacagcagatcgcccagttcaccgcgcagatcgtcaaaatcttcacgggcgatggcgtccagcacctcgtaggtttcttcaagggtgtaaggcgcaatggtggcaaatgtctgctctttatcccacgggcagccgttttccgggtcgcgcaggcgctgcatgacggtgagcaaacggtcgatttgattcattgaattatcctgaaaattgcgggtccgtcaggtggaaacctgtgaccagaatagaagtgagttagtaacacctacccaatcagcacgttaattttggctttaatgagttgtaattcctctggggcaactgttcctttcttcgttgctcctcttgcccgccaggcgatactttttacctgatcagctaacgctacgccatcacgttcctgaccggatagaacaacttcgaacggatatccttttgattgcgttgtacaaggaacacacagacacatacctgttttgttgttgtacatgaacggactcaggacaacagccggacgatgtccggcttgctcgctaccttttgtcgggtcaaaatcaacccaaatcagatcgcccgtatcgggtacgtatcggcttaccattaccagacttccttatctttcggctccccccagtcgatattctcgtggaggttttccggcgtgatgtcgttgaccagttcagcaagcgtaaatacgggctctttaagcactggctcaataattaatttgccatccaccaggtcaatcttcacttcatcatcaatattcagattgagcgcctgcattaacgtagccgggatccgcaccgccggtgaatttccccaacgctttacgctactgtggatcataaccctttcctcaaaccgcgatcatatgtagatacagtatatatcaatctacattgtagatacgagcaagtttcggcctaactcccgtgcaaccgacgcgcgtcgataacatccggcacctggttgagtttacccagcacgcgacccagcacttgcaggttgtaaatctcaatggtcatgtcgatggtcgccagttgctgtttggtgtcgctacggctggcaacgccaagtacgttcaccttctcgttggcgagaatggtcgtgatatcacgtaacaacccactacgatcattagccaccacgcggaccaccagcgaatatccggcggagtagctctcgccccataccgcgtcaacaatgcgttctggcgcatgggagcgcagttccgccaattgttcgcaatcggcgcggtgtactgaaataccgcgcccttgggtaatgaagccgacaatctcatctccaggaatcggctggcagcagcgcgcgatgtggtgcatcaggttaccgaccccttctaccaccacacgaccgttatctttactgcggttttgcggcgtgtagcttttttgctgaagctgtttcagcgcggcggcgtcctgctcttcggcactcggcttattaaattgcgattgcaggaagttcaccatctgattgagacggatatccccgccaccaatcgccgccagcaactcgtcgacatcattgaagttgtaacgcggcagcagatgtttttctgcttctttcaggctgatccccagatgttccagctcgtcgtcaagaatttgccgcccagccagaatgtttttgtcacggtcctgtttacggaaccaggcgtgaattttcgaacgcccacggctggttgtgacgtaaccgaggtttgggtttaaccagtcacggctggggttcggctgtttctgggtgataatttcaatctggtcgcccatctgcagctggtaggtgaacggcacaatgcgcccgccaatttttgccccgatgcagcggtgtccgacatcactgtggatgtggtaagcgaagtccagcggcgttgatcccgcaggcaaatcaacgacatcacctttcggcgtaaagacgtacactcggtcgtcaaagacctgactacgtacttcgtcgagcatttcgccggaatcagccatctcttcctgccacgcaatcagtttacgcagccaggcaatccggtcttcatgtcccgaacgtgcgccgccagcagccgcgccctctttatatttccagtgcgcagcaacacccaactctgcatcttcatgcatctgtttggtgcggatttggatctcaacggttttgccacccggccccagaaccacggtatgaatggactgataaccgtttggtttcgggttagcgacgtaatcgtcaaactcatccggcaggtggcgatagtgagtgtgcactatccccagtgcggcataacaatcctgtaaacgctcggcgacaatacgtaccgcacgcacatcaaacagctcatcgaaggcgaggttctttttctgcattttgcgccagatactgtagatgtgtttcggacggccatacacttcagctttaacgccttcagctttcatctcagcgcgcagatggccgacaaactcttcgatatagtgttcgcggtcgagacggcgttcatgcagcagttttgcgatgcgtttgtattcggtcgggtggagataacggaagcagtaatcttccagctcccatttcagttgcccaatcccaagacggttcgccaacggcgcgtagatattggtgcactcttttgccgccagtacgcgttcatcttccggcgcatcttttacttcgcgcaggtgagcaatacgctccgccagtttgatgaccacgcagcgaaaatcatcgaccatcgccaataacatccggcgaacgttatcgacctgttcggaggaaacagaatcagtgtgcgtcgctttcagctggcggatcgccgccatatcacgcacgccgtgaataaggttaacgaccgacttaccgacgctctcacgcagcacatcttcgctgactacgttggcatcagccagagggaacagcagcgccgcccgcagcgtgtcaatgtccatacttaatgtcgagaggatctccaccatctcaacaccacgccacaataacagactggcatccggatgcccctgcgtctgttgcagacaatacgcccaggtttcggctaagcactcacacgacttctggctggtaatacccagacttgcgatccatttttccggatcaaattcaccagccttattgatatgtgcacttcttaccgcaaccatcgtcctctcctttagggaccagacctgccgaaatcggcaaatcgtaactatttaacgcgcgagaaaagtaccatcgattccagatgtcccgtgtgtgggaacatatccagcatcgccagtcgcgcaatggtatatcctgcttttaataacgcttcgctatcccgagccagcgttgcagggttacaggatacataaactatacgaataggttccagttttataatttgctgcataacacctgcggcacctgctcgcgccgggtccaacaacactttatcgaagccgtttttcgcccacggctgctttgtgacatcttcttcaagattttcgtgataaaacgtcacattctgtaagccattaagacgcgcattctgctggcctttttccaccagcgccggaacaccttctacacccaccacactggcagcttgtgtcgccaatggcagtgtaaagttgcccataccgcagaacagatccagtacgcgatcttcaggttccacatccagccattccaacgcacgcgctaccattttctggttcacacccgcattgacctgaataaaatcgcgcgggctaaaagttaagcgcaacccatttgagtcataccagggcatctcaccagagacggtttcgagtatctcactatcgggggcgagatacagatccaggccttcagaatgcgaaaagcattccagtttttcgcgatctgccgaacttagcggtgcggtatggcgcaaaatcattagcgtgccgctggttgcctgtaccagttcaacatgaccaagatggcgcatagcttgtaagctgcccaggcatgccctgactttgggcagcaatgcttcaagttggggcactaaaatggggcattgtttcacgtcgacaatgtcactggagcccgctttgcgaaaccccatctgaagttgctgtgttttcggtaagtagttcagacttaaacgcgcgcgacggcgatagccccagggaacatcggcgatcacttcagagacttcgtgtttcattaatcgggcgagtgccgcacttttgcttcgctgctgtaaatccacactggcgtgttgttgctgacagccgccgcatacgccaaaatgaggacagcgtggcgtttcgcgttccgggctatcgcttaaccgacgtacgactttagcgcgggcatactgttttttatcttcagtaacagtaacttccgcgttttcctgcggcaataatccggggataaacaacgttttgccgttatgtcgcgccacgccctgaccaaaagagtcgaggtcgttgactgaaacggttatgatctgacgcgtcgtcgtgcgtcgttttgcagagtagaattgcgccattggcgagactttctcaatttaacagtgtgaccttaattgtcccataacggaactccatgaccaactacagcctgcgcgcacgcatgatgattctgatcctggcaccgaccgtccttattggtttattgctgagtatctttttcgtcgtgcatcgctataacgacttgcagcgtcaactggaagatgccggtgccagtattattgagccgcttgcagtttctactgaatatggcatgagcctgcaaaatcgcgaatctatcggtcagttaataagcgtactgcatcgtcgccattccgatattgttcgcgcaatttcggtttatgatgaaaataaccgactctttgtcacctccaattttcatcttgatccctcatcaatgcagctcggcagcaacgtgccgtttcctcgccagctcactgtcactcgtgacggcgatattatgatcctccgcacgccgattatttctgaaagttactcccccgacgaatcgcccagtagcgatgccaaaaatagtcaaaatatgctgggatatattgcgctggagctggatcttaaatcggttcgcttgcagcaatataaagagatctttatttccagcgtgatgatgctgttttgtatcggtattgcgcttatttttggctggcgcttaatgcgcgatgtaaccggtccgattcgcaacatggtgaataccgtcgaccgcatccgtcgcgggcaactcgacagccgggtggaaggatttatgctcggcgagctggatatgctgaaaaacggtatcaactcgatggcaatgtcgctggcggcttatcacgaagagatgcaacacaatatcgaccaggcgacgtccgatctgcgtgagacgctggagcaaatggagattcagaacgttgagttggatctggcgaaaaagcgcgcccaggaagcggcgcgtattaaatccgagtttctggcaaatatgtcacacgagctgcgtacaccactgaatggtgttattggctttacccgcctgacgctgaaaacagaattaacaccaacgcagcgcgatcacctgaatacgattgaacgttcggcaaataatttgctggcaattattaatgatgttctcgacttctcgaaactggaagccggtaagctgattctggaaagtattccattcccactacgcagcacgctggatgaagtcgttaccctgctggcacattcttctcacgataaagggctggaactgacgctcaatattaaaagcgacgtgcctgataacgtgatcggcgacccactacgattacagcaaatcatcactaacctggtagggaatgcaattaaattcaccgagaatggcaacatcgatattctggtagaaaaacgtgcgctgagtaataccaaagtgcagattgaagtgcagattcgggataccggcattggtattcctgaacgcgatcaatcgcgcttattccaggccttcagacaggctgatgccagtatttcccgccgtcatggtggcaccgggctggggctggtgattacacaaaaactggttaatgaaatgggcggcgatatttcgttccatagcctgccgaatcgtggttcaactttctggttccacattaatctcgatctgaacccgaacattattatcgaagggccatccacccagtgcctcgctggtaagcgcctggcctatgtcgaaccaaactccgcagcagcacaatgcacgctggatattttaagtgaaacgccgctggaagtggtttatagcccaacgttctccgcgctgcctcccgcgcattacgacatgatgttattaggcatagcggtgaccttccgcgagccgctaacaatgcaacatgagcgattagcgaaagcagtatcgatgaccgatttcctgatgctggcacttccttgccatgcacaagtcaatgctgaaaaacttaagcaagatggtatcggcgcgtgtctgctgaaaccattaacacctacgcgcctgttgcctgccctgacggaattttgtcatcacaaacaaaacacgcttttgcctgtaaccgatgaaagtaagctggcaatgacagtcatggcggttgatgacaaccccgctaacctgaaacttatcggcgcattgctggaagatatggtgcaacatgtggaactttgcgatagcgggcatcaggcggttgaacgggcgaaacagatgccgttcgatttaatcttaatggatattcaaatgccggacatggacggcattcgggcatgtgagctcatccaccagctcccgcatcagcagcaaacgccggttatcgcggtaacggcgcatgcgatggccgggcaaaaagagaaactgcttggcgcggggatgagtgattatctggccaaaccgatcgaagaagagcgattgcataatttgctgttgcgctacaagcctggcagcggtatttcctctcgcgtcgtgacgcccgaagtcaacgaaattgtggtcaacccgaatgcgaccctcgactggcaactggcactacgccaggcagcaggaaaaaccgatttagcgcgcgatatgctgcaaatgttactcgatttcctgcctgaagttcgcaacaaagttgaggaacagctggttggagaaaacccggaaggcctggttgatttgattcataaactgcatggcagttgcggctatagcggtgtaccgcgtatgaagaatctctgccaactgatcgaacaacagctacgtagcggtactaaagaagaagatttagagccggagctgctggaactgttggacgagatggataatgtagcgcgcgaagccagcaaaattctcgggtaatggacgtcttgtcgagtagcaaccggatttttatgacgctggtttcagattagtgacaagtgcctgtgtttatgccggatgcggcgttaacgccttatccggcctgcaaaaccaattaaattcaatgaattaaaaaatgatgtagccctgatacgtagcgcaacaggcaattttgcgtttggcatcagtctcaaaccggctcctgacagagccggtttttgttttcagtcttaacgcaccatgcacgggcgcttgttatcaaacgtccagccaggaatcaggtactgcattcccatcgcatcgtcacgcgcgccaagcccgtgtttctgatacagctcgtgggctttcatcacctgatccatatcgatttctacgcccaatcctggtttttgcggcacctgtaccagcccgcctttgatctcaaacggttctttggtcagacgctgattgccttcctgccagatccagtgcgtatcaatcgcagtaattttacccggtgcagcagcggctacatgggtaaacatcgccagggaaatatcgaagtggttgttagagtgtgaaccccaggtcaggccaaattcatggcacatttgcgccacacgtaccgaaccttgcatcgtccagaaatgcggatccgccagcgggatatcaacggattgcaacgagagcgtatggcccatctgccgccagtcggtggcgatcatattggttgcggtcggcaggccagtcgcgcgacggaactctgccatcacttcacgcccggagaaaccttgctccgcaccacacggatcttctgcataagccagcgaacctttcaggtatttaccaattttaatcgcttcgttcagcgaccaggcaccgttaggatcgagggtaatacgcgcctgtgggaagcgttgcgccagtgccacaatagattctgcttcttcttccccggccagtacaccgcccttcagtttgaaatcgttgaagccatatttttcatatgccgcttccgccaggcgcaccaccgcatccggcgtcatcgcttcttcgtgacgcaggcgataccagtcacatttatcatccggctggctttgatacggcagcggtgtggctttgcgattaccgacgaagaacagataaccgagcatttcgacttcgctacgctgttgaccatcgcccagcagcgatgccacgttaacccccagatgctgccccagcagatccagcattgccgcttctatcccggtaaccacatgaatagtggtccgcaaatcaaatgtctgcaaaccgcgcccgccggcatcacgatcggcaaatgtattacgcaccagcgtcagaacgtttttgtattcacccagcattttacccaccaccagcggaatcgcatcttccagcgttttacggattttctcgccgccgggaatttcccctaccccagtgtgaccagaattatctttgataatcacaatattacgcgtgaagaacggtgcgtgtgcaccactcagattcatcagcatactgtcatggcccgccaccgggatgacctgcatttcagtaacaacaggcgtcgtaaattgagaactcatctttatgtcctttttcaaaatcaatgacggccgaaaacgggacgtttacggtcaaaggtccagccggggatcaggtactgcatcgggcccgcatcgttacgcgcaccgccaggcagacgtttataggcctcatgcgccttttgtacctgctcccagtccagttccacgcccagaccgggcgcatcaggaacggcaatttttccgtttttaatctccagcggatttttggtcaggcgacaatctccctcctgccaaatccagtgggtatcgatagcggtaggattacccggtgccgccgcgcccacatgggtaaacatcgccagagagatatcaaagtggttattagaatggcagccccaggtcagcccccagtcgtcgcaaagttgcgccacgcggactgcaccggaaagcgtccagaaatgcggatcggcaagtggaatatccaccgcattgagcattaccgcatggcccatttcgcgccagttggtggcgatcatattagtcgcgacgggcaagccggtcgcccgtcgaaactccgccatcacttcacgtccggagaaaccctgttctgcgccacacggatcttcggcataggtgagaacatcattcagccctttgcacagagaaatagcttcatcaagcagccatgctccgttgggatcaacggtaatccgcgcatcagggaagcgtttcttcaatgcacgaacagtgtcgatttcttgctcgccaggtaacacgccacccttaagtttgaaatctttaaagccatagcgatcctgtgaggcttccgccagacgcacaacggcttcgctgttcatcgctttctgatgccgcaactgataccactcatggttgcccggcgtattttccagataaggaagatcggttttggtccgatcaccgatataaaacagataaccgagaacggtaatagcatcacgttgcttgcctggccctaacagttcgcagaccggaacattcagcgcctgacctaacaggtcaagcaaggcggcttccagcgccgccacggcattaacgcgcaattcaaaagtccaggcacctttgccgaaggtatcaaaatcggctgcctgattacctttatgcacctgctgaaccactttattcaggcgcgcaacttcctggcccagcaccatcggaatagccttgaccagtgtttgataaatcacctctccgcccggcgcttcaccaatgccggtatgcccggcattatcggtgagtaccacaatattgcgggtgaaatatgcgttatgtgcaccaccaatattaagcaacatgctgtcatgtccggcgaccggaatgactttcatatcagtaataacaggactggattgtgtcgtcatcttattgccccgcgacaggtttcagctcaatacgcttgatatcgcccaccagcaccaggtagctgagtaccgcgattaaggcatgaacaccaacataaatcagcgccccattaaaggagccagtcgtgccaacgatataaccaattgcgattggcgtgacgatgccagaaatgttaccaaacatgttaaacaggccaccggaaagaccgctgatctcttttggcgcagtatcagccattacagcccaacccagcgcaccgatccccttaccgaagaaggccagcgccataaagccgatgatcatccactcaacgttgacgtagttgcagaacaccatcaccatcgacaacaacatgcccatcacgatcggtgttttacgcgcaatgttcagtgaacccgtgcgacgcatcagccagtcggaaataatcccacccagcacaccgccgataaaaccgcaaaccgccggaacggaagccacaaagcccgctttcagaatcgacatcccgcgcgcctgcaccagataaaccgggaaccaggtaataaaaaagtaagtcagggcgttgatacagtactgaccgatataaacgccgatcatcatccgtgacccgagcagctgtttgatctgcccccacttcacgctaaacggcactttaactttggtgttttgctgatccatattgatcagcgcgccacccgcggcgatgtactccagctctttctgatttacgcccggatgttgatttggctcgtggatgactttcaaccagataaagctgatgacaatgcccagaccgcccataaagaaaaagacgtgtgaccagcccacttcatgcgtcagccagcccataatcggcgcgaagataaccgttgcgaagtattgagcggagttaaaaatcgacaccgccgttcccctttcctgcgccggaaaccaggccgcaacaatgcgactgttgccggggaaagagggcgcttcagcaagcccgaccaggaagcgcagcgtaaacagggcaacgataatgccgaatccactaaagatatcgacgaagccttgcagcaaggtaaacatcgaccagataaagatcgaccagaagtagacgcgttttgaaccaaaacgatccagcaaccagccacctgggatctgcccgataacatacgcccatgagaaggcagagaacacatagcccattcccacgggatcaaggccgatatctttggccatttccgaaccggcaatagaaagcgtagcgcggtcgccgtagttgaaggatgtgacgataaacaacatcaccactatccagtaacgagcattcgtgcgtttttccacactgctcgcagcctgacttaaagaactcattgttgcactcctgaaaattcgcgttagccacgctcactctggactgcgacatcgccaggaaatcagaggtgacgtagggtgtttttgccgtttttataggtcgttcgccgaatacggcgcgtgtttatatctggcaatagcagtataaaaagcgcgccatagcggctcaccgtgcaacaacacaacattaatgcgttcaatgaggcccgattttggcattagccctggacggtggaatccacttcacggaaatgaaaacaagaacaagaaaggaagggttaaaacgaagaaataaagaagagtatgaaatggatcgcttgactccaggcaaacgccagtaaaaatccgcgctatgaagcagtttttactggcatttgcctgaaaagattcgattcagcaccgctaaaacggcatttaccgctcgctgaacatatcaggacaacatcgtgccccaatgttcaacccacggatttgattccgtttccggttccgggttctcactggcgtcaatcaacagcatttcgccaacccgctgagcgctctgttcctgcaacaaggcatcgaactgtttgccgccattgcagaaattcacataactactgtcgccgagcgcaatcacgccataacgcagattcggctggaagcccagactatctttgattccctgaaagagtggcacaatgctatcaggaaggtcgccctgcccggtcgtggacgtaaccaccagaacatacttatcctgatagggcagccagtcgcttaattcaggatcttcaaataccgttgctttgtggccctgcgcggtcagaatcgcttccgcttcttcggccactaacagtgaattcccgtacatggtgccgacaaaaataccaatttccgccataccgttttctccctggattaggaacttatctctccatcctgacccgatggcgcactgaactcaaccctttcattttcaggaagcagaccgcgccagccaaattgtgataacgcctgcatccaggtgtcgtccaggcccgcgtgaatagtcagcggctcgccagtaaaaggatgcgtcaatgacaactgactggcatgcagcattaaccgctgaaggccaaaatgctcagcaccgctgcgattctggcgtaaatcaccatgtttgctgtcgccaataatcgggtgccgcaaatgggcaagatggcgacgaagctggtgcttgcgtccagttttcggctccagttccaccaggccgtagcgcgtggtcgggtaacgtccggtcgctaccggcatttctacggtcgccagaccgcgataatgcgtcactgctggctgcgggcctttatcttcgcgggcaaatttatcagcgattttgtccagttcttccaccagtggataatccagcaccgcttcttccatcaaccagccacgcacaatcgcatggtaacgtttctggatttggtgctgttcaaactgttgtgccagcagccgtccggcttcgctggataatcccatcaacaacacaccagaagttggtcggtccagacgatgagcagtaaaaacatgctggcctatctggtcacgcacggtttgcatgaccactactttctcgtcgcgatccagccagctgcggtgaaccaaccagccggagggtttatttaccgcaaccagccattcatcctgatagagtatttccagcattagctcgcatcatccgcaaaaagagcatccagtttttccagctctgccagaataagcgcgcgttgcgggtggtccgtcgccagcgccatttcataatagggcgcaacagcaaaagcgcccggtaacggctggttgttatctaacaaatcgtgcattcgcgggatcagcacccactgcaaccactccagtggttccatggtgtccataaagaacggttgagtactgttaaattgatgcggcaggggttcatcgtttcgccagtgctgatgttcacgcagtaacgcttcaagcgcctgcaactggagacgaacgcggtcatgagtggtcataaagcaacctcaataagaaaaactgccgcgaagaatagcaggaataaaaaaagggagcactgtattcacagtgctcccggttcgtttcgcagcattccggctacttttgttgctccctgctcatccttgacaacttttcctctggccttgcggccaatcgttcatcctgaactattgcttcccgctcacaccaccccgatgtgatacttcatcctgaagtgttcctggccttcctgacccaccgaatcatcctgaccggttctcattctccatcctggaggtgtcctttaacgtgtcctgcgtcatcctcttcgcttcatccagaagcctttccctgaaacaccatcctggtgtgtccttcagaagtgtcatcatcctgatgttcacttcgttgtctgactccctgtcgacgaagatagaatcgtctttttctcgaagtcttacaaggcgcttacagacaatgccttaaggaaaatttcatatgaaagttaagaattaacaagcaacatgttgtttttaaatgagaataacgattcttatctttttaagtattcgcttatttcctggcgatctcctacagagtctgtaagagatctctcacaaccagatggggtatttggattacagaagaggcttaagttgattaaggaattccgcaagatttgaggctaaatgcgtccgtttacgtgttcccagcgtctctttgcacacttcaccggagagattacacaccgagatgacctctaactcttcttccagcgtcgcgataaatagcgtgggcggcagttttagccttttctgagtcaccagatgaccaatcagattttcctgcacccgacggaagtcgtcttcactccaggtttgcagcaatgtcagtttgatatcgccaaactgcgcgtgcatatccccggcaaactgagtcgtataaaaggtatgaatcgtgggttgtatcacaatatcaaaagcgcgttcaaccgcgtttacattttgttccccggtaaacggctggggttgccagtatatggcatcttcggtagttgaaataatgcacggtgaaggaacgccgtacagttcctcacttaacggccagcttttatgctcttcatgccacgcatcgcagtagcgtgcagtaaaatctttcagggcttgtgcggtcaaatcgtccactaatttctctcttcacttaaaccagatacacttgtcgtttagtttatctggtttatgacggtgaaacatgtcttcttatgcaaaccatcaggcacttgcgggcctgacacttggaaaatcaaccgattaccgggatacctatgacgccagcctactgcaaggcgttccacgcagcctgaatcgcgacccgctgggtctgaaagcggataacctgccttttcacggtacggatatctggacgctgtatgaactttcctggctgaatgcgaaaggtttgccgcaggtcgctgtcggtcatgttgaacttgattacaccagcgtaaatctgattgagtcgaagagttttaagctctatctcaacagttttaaccagacgcgttttaataactgggatgaggtgcgccagacgctggagcgcgacttaagcacttgcgcccagggtaaggttagcgtggcgttatatcgtcttgatgaactggaaggccagccgataggtcatttcaatggcacctgcattgatgaccaggatatcactatcgataactatgaattcactactgactatctggagaatgccaccagcggtgaaaaagtagtggaagagacgcttgtcagccacctgctgaaatcaaactgcctgatcacccatcaaccagattggggttcgatccaaattcagtatcgtggacgccaaattgacagagaaaaactgctgcgttacctggtctctttccgtcatcacaacgagttccacgaacagtgcgtggaacgcatctttaatgacctgttacgcttctgccagccagaaaaattgagcgtttacgcacgttatacccgtcgtggcggtctggacattaacccgtggcgcagtaataacgattttgtcccatcgaccacaagactggttcggcaataaattttttctcaattttgcgtgctggattcacgcagaaggttgtgaaaggtcagcaggcagggctattgtaatcaaagggaatgacgatattcgtcccataaggagtttttcttgattacacatattagcccgcttggctccatggatatgttgtcgcagctggaagtggatatgcttaaacgcaccgccagcagcgacctctatcaactgtttcgcaactgttcacttgccgtactgaactccggtagtttgaccgataacagcaaagaattgctgtctcgttttgaaaatttcgatattaacgtcctgcgccgtgaacgcggcgtaaagctggaactgataaatcccccggaagaggcttttgtcgatgggcgaattattcgcgctttgcaggccaacttgttcgcggttctgcgtgacattctcttcgtttatgggcaaattcataacaccgttcgttttcccaacctgaatctcgacaactccgtccacatcactaacctggtcttttccatcttgcgtaacgctcgcgcgctgcatgtcggtgaagcgccaaatatggtggtctgctggggcggtcactcaattaacgaaaacgagtatttgtatgcccgtcgcgtagggaaccagctgggcctgcgtgagctgaatatctgcaccggctgtggtccgggagcgatggaagcgccgatgaaaggtgctgcggtcggacacgcgcagcagcgttacaaagacagtcgctttattggtatgacagagccgtcgattatcgccgctgaaccgcctaacccgctggtcaacgaattgatcatcatgccagatatcgaaaaacgtctggaagcgtttgtccgtatcgctcacggtatcattatcttccctggcggtgtgggtacagcagaagagttgctgtatttgctgggaattttaatgaacccggccaacaaagatcaggttttaccattgatcctcaccggcccgaaagagagcgccgactacttccgcgtactggacgagtttgtcgtgcatacgctgggtgaaaacgcgcgccgccattaccgcatcatcattgatgacgccgctgaagtcgctcgtcagatgaaaaaatcgatgccgctggtgaaagaaaatcgccgcgacactggtgacgcttacagctttaactggtcaatgcgcattgcgccagatttgcaaatgccgtttgagccgtctcacgagaatatggctaatctgaagctttacccggatcaacccgttgaagtgctggctgccgacctgcgccgtgcgttctccggtattgtggcgggtaatgtaaaagaagtcggtattcgcgccattgaaaagtttggtccttacaaaatcaacggcgataaagagattatgcgtcgtatggacgacctgctacagggttttgttgcccagcatcgtatgaagttgccaggctcagcctacatcccttgctacgaaatctgcacgtaatctcccctcccccggtgacgtttgttgccgggttttctcatttttggtcacttactcatcaactcatttcatttgttatatgaatgtttcttaccaccctcacgcgacaaatatcaccacagttaatatgtcatacaatttatgttgaaacgcaaacgtttccctattttcataaaccatattttattgccatgaaaaagaaattatcgccatgattgactaaaagtattgattttttcagttcaacctacatatattgcgcgccccgtaagaagtcagatgtcgtttaatgggtaaatattgcccttaaattctcttttacttttgatttacagagtaaagcgttgtgattatctatcttccaagtagattattgtatttgggatcaagatcactgatagatacataacttgtgtgtatctttccgccctcaaattattacggtggaaaatgattaagccatcgccgatagacagatttcatttttacggtcaggcaccttcccgggctgaactggctaaaagctgaattatttgcattcctccaggagaaatagatggaaacgactcaaaccagcacgattgcgtcgaaagactctcgtagtgcctggcgcaagacagacaccatgtggatgctgggcctttacggcacggcaatcggcgcgggcgtgctgttcctgccaatcaacgctggtgttggcggtatgatcccgctgatcatcatggctatccttgcgttcccgatgacgttttttgctcaccgcggcctgactcgcttcgtactgtctggtaaaaacccgggcgaagacatcaccgaggttgtagaagaacactttggtattggcgcaggtaaactgattactctgctctacttcttcgctatctacccgatcctgctggtttatagcgtggcaatcaccaatacagttgaaagcttcatgtctcaccagctgggtatgacgccaccgccgcgtgcgattctgtcgctgatcctgatcgtgggtatgatgaccatcgttcgcttcggtgagcagatgatcgttaaagcgatgagtattctggtattcccgtttgttggcgtactgatgctgctggctctgtacctgatcccgcagtggaacggcgcagcactggaaacgctgtctctggacactgcatctgcaaccggaaacggtctgtggatgacactgtggctggcaattccggtaatggtgttctcgttcaaccactctccgatcatctcttctttcgccgttgcgaagcgtgaagagtacggcgatatggcagaacagaaatgctcgaagatcctggcattcgcacacatcatgatggtgctgaccgtaatgttcttcgtcttcagctgcgtactgagcctgactccggcagacctggctgcggctaaagagcagaacatctcgattctgtcttacctggctaaccactttaacgcgccgatcatcgcgtggatggctccgattatcgcgattatcgctatcaccaaatccttcctcggccactacctgggcgcacgtgaaggcttcaacggtatggtgattaaatctctgcgtggtaaaggtaagtctatcgaaatcaacaagctgaaccgtatcactgcgctgttcatgctggtaacgacctggattgttgccaccctgaacccgagcatcctgggtatgattgaaaccctgggcggcccaatcatcgcgatgatcctgttcctgatgccgatgtacgcaattcagaaagtaccggcaatgcgtaaatacagcggtcacatcagcaacgtattcgttgtcgtgatgggtctgattgcaatctccgcaatcttctactctctgttcagctaagtcctttcgcgccgctttcgggcggcgcttcctccgttttaacgcgatgtatttcctatgattagcgtattcgatattttcaaaatcggcattggcccttccagttctcataccgttggaccaatgaaagcgggtaaacaatttaccgacgatctgattgcccgtaacctgcttaaagacgtgacccgcgtggtggttgacgtgtacggctcgctctctctgaccggtaaaggccaccacacagatatcgccataattatgggtctggcgggtaacctgccggataccgtggatatcgattccatccctggttttattcaggatgtgaatactcatggtcgcctgatgctggcaaacggtcagcatgaagtggagttcccggttgatcagtgcatgaacttccatgccgacaacctttctctgcatgaaaacggtatgcgcattaccgcgctggcgggcgataaagtcgtttacagccagacttactactctattggcggtggctttattgttgatgaagaacattttggtcagcaggatagcgcaccggttgaagttccttatccgtacagttcagcagccgatctgcaaaaacattgtcaggaaaccgggctgtcactctctggcctgatgatgaaaaacgagctggcgctgcacagcaaagaagagctggaacagcacctggctaacgtctgggaagtcatgcgtggcggtattgagcgcggtatttctaccgaaggcgtgttacctggcaaactgcgcgttccacgccgtgctgcagcactacgccggatgctggtcagccaggataaaaccaccactgacccgatggcggttgttgactggatcaacatgtttgcactggcagtgaacgaagagaatgctgctggcggtcgcgtggtgactgcgccgactaacggtgcgtgcgggattattccggccgtgctggcgtactacgacaagtttatccgcgaagtgaacgctaactcactggctcgttacctgctggtagccagcgccattggttctctttataagatgaacgcctcgatttctggtgccgaagtcggctgccagggtgaagtcggcgtggcgtgctcaatggcggcagctggtctggcagaactgttaggcgcaagcccggcgcaggtatgcatcgcggcggaaatcgccatggagcacaacctcggtctgacgtgtgacccggtcgccgggcaggtacaggtgccgtgcatcgagcgtaacgccattgcggcagtgaaagcagtaaacgctgcacgtatggcgctgcgccgtaccagcgagccacgcgtctgcctcgataaagttatcgaaactatgtacgaaacaggtaaagatatgaacgccaagtaccgcgaaacctctcgcggcggcctggcaatgaagatcgttgcctgcgattaatcgctctccagaggcctctttttgcgaggcctcttcccgatttctcatccagccatagcctgttctggcatcgaatgttacccttatcgcctgatctttaagggggttatcgtggctgttcatttgcttattgtcgatgcactgaatcttattcgtcgcattcatgccgttcagggttcgccctgtgtcgaaacctgccagcacgcgctcgatcagctcattatgcacagccagccaacccacgcggtcgccgtttttgatgatgaaaaccgcagtagcggctggcgtcatcagcgtttaccagattacaaagcgggtcgaccgccaatgccggaagagttgcacaacgagatgcctgcattacgcgccgcctttgagcaacgtggcgtcccgtgctggtccgccagcggcaacgaagccgatgacttagccgccacgctggcggtcaaagtgacacaggccgggcatcaggcaacgattgtttcgacagataaaggctactgtcagttactttcaccgacattacgtattcgtgattacttccagaaacgttggctggatgcgccatttatcgataaagaatttggcgttcaaccgcagcagttgcccgattactgggggcttgcggggatcagcagttcaaaggtaccgggtgttgcggggatcggaccaaaaagcgccacacagctactggtcgagtttcagagtctggaagggatatatgagaatctggatgcggttgccgaaaagtggcgcaaaaaattagaaacccataaagagatggcgtttctgtgccgcgatattgcccgcttacaaaccgatatgcatatcgacggcaatttacagcaattgcggttggtaaggtaacggcgtgccggatgcaaacgattatcaacacattgaatttcatgcacttatatgccggataagacgcggctagcgtcgcatccggcattatcacatcagcgtatttaccaggcggtatggtaaagctctacaatatcctcaagcgttgcttcacgcgggttgccaccggtacaaacatcatccagtgccgcctgcgccagtgccggaatgtcttccttgcgtacaccaacatcacgtaaatgtggcggaataccgacatcacggttgagagcaaacaccgcttcaacagcggcattacgcgcctcttccaggctcataccttccactttcacgcccataacgcgcgcgatatcgtggtacttctcaccggtaaaatcagcgttatagcgcatgacatgcggtaacaggatggcatttgcaacaccgtgtggcgtgttgtaaaacgcgcccagtggatgcgccataccatgcaccaaccctaacccaacattcgagaatcccatacccgcaacatactgcccgagcgccatttcttctccggcatccttatcaccagcaaccgatcctcgcagcgccccagcaatgatttcaatcgctttaatgtgcagcgcatcggttagcgcccacgcgccacgggtaatatacccctcaatagcatgagtgagcgcatcgacacccgtcgcggctttcagcgctggaggcataccatccatcatgtcagcgtcaataaacgccacctgcgggatatcatgcggatcaacgcaaacaaacttgcgccgtttctcttcgtcagtgatcacgtagttaatggtcacttctgccgcagtgcctgctgtggtggggattgccagaatcggtacactgggtttattggtcggggaaagcccttccaggctacgcacatcggcaaactccgggttgttgctgataatgccaatcgctttacacgtatcctgtggagaaccaccaccaatagcgatcaggtaatccgcgccgctattctggaatacatcgagcccttctttgacgacagtaattgttgggttaggtactacgccgtcgtaaatcgcccatgccagtcctgccgcatccatcttatcgatcactttcgccaccacgccgcattgcaccagcgttttatcggtgacgatcagcgccttctgataaccacggcgtttcacctcatcggttaaagacccaacagccccccgaccaaaccatgccgtttcgttcagaatcattctgttagccatcatccttctccttgttgctttacgaaattactcttcaatccgtaacccgtaggttttgaatttctccagcactacggcaatctcttcatcgctcagcactggcaccgggtccgtaatcgccagggtcgtcaggtaaagttgtgccagcacttcaacttcatgcgccagccataacgctttctccagattcgcctcacaagcgataagcccatgatgttgtaacaaagttgccttacgatttttgagagccagcgcaacatgttcagaaagttcgcgtgttccaaaggtcgcataaggcgcgcaaggaatagaattaccgccagccgccgcaatcatgtagtgaatcgcggggatcggtcggttaagaatggaaactgccgtacaatgaacggcatgattgtgaacaaccgcgttggcatccggtctgctttgataggccgccatatggaaacgccactcgcttgaggggagttttccttcctcatgtttgccgttgccatcaataaagacaatatgcgactccgtcagtttttcatatggaatacctgtaggcgtaatcagcatcccatcctgataacgtacactgacgttacccgctgtcccctggttcagccccaggcgagtcatttccaggcaagtgtcaataatctgacgagcaagtttatttcgttccattagctacctctctctgattcaaaacagggcaataatgttgttcctttcacactattgaattagccgtttaattacccaccatcttcttcctgattaaccagaaagaaattcacaagcttatattttgtgacctggttcaactaatcacagtaaataactgcaagttctctttttataactccattaaaaatgaccgctcttaaaaatatttatcaaaacggtcatttttctactcctccctgccaggaatgcccgttttcggcacaaacaattaatacggtcatctggtttgtgttttttatgatttattttctgaaacgggcatgaaatttcgattattaaagtgatggtagtcacataaagtcaccttccggctaataagtgtgaccgccgtcatattacagagcgttttttatttgaaaatgaatccatgagttcatttcagacaggcaaatattcactgatatgaagcccgaactcgctggttttgcacttttgaaaacataaccgattacgtgcttaagcttctgaacctaagaggatgctatgggaaacacatcaatacaaacgcagagttaccgtgcggtagataaagatgcagggcaaagcagaagttacattattccattcgcgctgctgtgctcactgttttttctttgggcggtagccaataaccttaacgacattttattgcctcaattccagcaggcttttacgctgacaaatttccaggctggcctgatccaatcggccttttactttggttatttcattatcccaatccctgccgggatattgatgaaaaaactcagttataaagcagggattattaccggattgtttttatatgctttcggcgctgcattattctggcccgccgcagaaataatgaactacaccttgtttttagttggcctatttattattgcagccggattaggttgtctggaaactgccgcaaacccttttgttacggtattagggccggaaagcagtggtcacttccgcttaaatcttgcgcaaacatttaactcatttggcgcaattatcgcggttgtctttgggcaaagtcttattttgtctaacgtgccacatcaatcgcaagacgttctcgataaaatgtctccagagcaattgagtgcgtataaacacagcctggtattatcggtacagacaccttatatgatcatcgtggctatcgtgttactggtcgccctgctgatcatgctgacgaaattcccggcattgcagagtgataatcacagtgacgccaaacaaggatcgttctccgcatcgctttctcgcctggcgcgtattcgccactggcgctgggcagtattagcgcaattctgctacgtcggcgcacaaacagcctgctggagctatttgattcgctacgctgtagaagaaattccaggtatgacagcaggctttgccgctaactatttaaccggaaccatggtgtgcttctttattggtcgtttcaccggtacctggctcatcagtcgcttcgcaccacacaaagtcctggcagcctacgcattaatcgctatggcactgtgcctgatctcagccttcgctggcggtcatgtgggtttaatagccctgactttatgcagtgcctttatgtcgattcagtacccaacaatcttctcgctgggcattaagaatctcggccaggacaccaaatacggttcgtccttcatcgttatgaccattattggcggcggtattgtcactccggtcatggggtttgtcagtgacgcagcgggcaacatccccactgccgaactgatcccggcactctgcttcgcagtcatctttatctttgcccgtttccgttctcaaacggcaactaactgaacatattttccgaataaagtgaggaatcagtaatgaaaaaaatcagcttaccgaaaattggtatccgcccggttattgacggtcgtcgcatgggtgttcgtgagtcgcttgaagaacaaacaatgaatatggcgaaagccacggctgcactgctgaccgagaaactgcgccatgcctgcggagctgccgtcgagtgtgtcatttccgatacctgtatcgcgggtatggctgaagccgctgcttgcgaagaaaaattcagcagtcagaatgtaggcctaaccattacggtaaccccttgctggtgctatggcagtgaaaccatcgatatggatccaacccgcccgaaagccatttggggctttaacggcactgaacgtcccggcgctgtttacctggcagcggctctggcagctcacagccagaaaggcatcccggcattctccatttacggtcatgacgttcaggatgccgatgacacatcgattcctgccgatgttgaagaaaaactgctgcgctttgcccgcgccggtttagcagtcgccagcatgaaaggtaaaagctatctgtcgctgggcggcgtttcgatgggtatcgccggttccatcgttgatcacaacttctttgaatcctggctgggaatgaaagtccaggcggtggatatgaccgaactgcgtcgccgtatcgatcagaagatttacgacgaagccgaactggaaatggcgctggcctgggctgataaaaacttccgctatggcgaagatgaaaataacaaacagtatcaacgcaatgccgagcaaagccgcgcagttctgcgcgaaagtttactgatggcgatgtgtatccgcgacatgatgcaaggcaacagcaaactggccgatattggtcgcgtggaagaatcacttggctacaacgccatcgctgcaggcttccaggggcaacgtcactggaccgatcaatatcccaatggcgataccgctgaagcgatcctcaacagttcatttgactggaatggcgtgcgcaaaccgtttgtcgtggcgaccgaaaacgacagtcttaacggcgtggcaatgttaatgggccaccagctcaccggcaccgctcaggtatttgccgatgtccgtacctactggtcaccagaagcaattgagcgtgtaacggggcataaactggacggactggcagaacacggcatcatccatttgatcaactccggttctgctgcgctggacggctcctgtaaacaacgcgacagcgaaggtaaaccgacgatgaagccgcactgggaaatctctcagcaagaggctgacgcttgcctcgccgctaccgaatggtgcccggcgatccacgaatacttccgtggcggcggttactcttcccgcttccttaccgaaggcggcgtcccgttcaccatgactcgtgtcaacatcatcaaaggcctgggaccggtactgcaaatcgcggaaggctggagcgtggaattgccgaaggatgtgcatgacatcctcaacaaacgcaccaactcaacctggccaaccacctggtttgcaccgcgcctcaccggtaaagggccgtttacggatgtgtactcggtaatggcgaactggggcgctaaccacggggttctgaccatcggccacgttggcgcagactttatcactcttgcctccatgctgcgtatcccggtatgtatgcacaacgttgaagagaccaaagtgtatcgtccttctgcctgggccgcgcacggcatggatattgaaggccaggattaccgcgcttgccagaactacggcccgttgtacaagcgttaatacattactccctgatgtgatgcccggtcgctccggctaccgggcctgaacaagcaagagtggttagccggataagcaatgttatccggctatattgcaggagcgattatgaaacaagaagttatcctggtactcgactgtggcgcgaccaatgtcagggccatcgcggttaatcggcagggaaaaattgttgcccgcgcctcaacgcctaatgccagcgatatcgcgatggaaaacaacacctggcaccagtggtctttagacgccattttgcaacgctttgctgattgctgtcggcaaatcaatagtgaactgactgattgccacatccgcggtatcgccgtcaccacctttggtgtggatggcgctctggtagataagcaaggcaatctgctctatccgatcattagctggaaatgtccgcgaacagccgcggtaatggacaatattgaacggttgatctccgaacagcagttgcaggctatttctggagtcggagcctttagtttcaatacgttatataagttggtgtggttgaaagaaaatcatccacaactgctggaacgcgcgcacgcctggctctttatttcgtcgctgattaaccaccgtttaaccggcgaattcactactgatatcacgatggccggaaccagccagatgctggatatccagcaacgcgatttcagtccgcaaattttacaagccaccggtattccacgccgactcttccctcgtctggtggaagcgggtgaacagattggtacgctacagaacagcgccgcagcaatgctcggcttacccgttggcataccggtgatttccgcaggtcacgatacccagttcgccctttttggcgctggtgccgaacaaaatgaacccgtgctctcttccggtacatgggaaattttaatggtccgcagcgcccaggttgatacttcgctgttaagtcagtacgccggttcgacctgcgaactggatagtcaggcagggttgtataacccaggtatgcaatggctggcatccggcgtgctggagtgggtgagaaaactgttctggacggcagaaactccctggcaaatgttgattgaagaagctcgtctgatcgcgcctggcgcagatggagtgaaaatgcagtgtgatttattgtcgtgtcagaacgctggctggcaaggcgtaacgcttaataccacgcgggggcatttctatcgcgcggcgctggaagggttaactgcgcaattacagcgcaatctacagatgctggaaaaaatcgggcactttaaggcctctgaattattgttagtcggtggaggaagtcgcaacacattgtggaatcagattaaagccaatatgcttgatattccggtaaaagttctcgacgacgccgaaacgaccgtcgcaggagctgcgctgttcggttggtatggcgtaggggaatttaacagcccggaggaagctcgcgcgcagattcattatcagtaccgttatttctacccgcaaactgaacctgaatttatagaggaagtgtgaaatgctgaaaacaatttcgccgttaatttctcccgaactattgaaagtgctggcagagatggggcatggagatgaaattattttttccgatgctcactttcccgcccattcgatgggaccgcaggtgatccgcgctgatggcctgttggtgagcgacttgctccaggcgattatcccgttatttgagctggacagttatgcaccaccgctggtgatgatggcggcggtagaaggtgacactctcgatcctgaagtagaacgacgttaccgtaatgcgctttcactacaagccccctgtcctgacatcatccgcatcaatcgttttgcgttttatgaacgggcgcaaaaagcctttgcgatcgttatcacaggcgaacgagcgaagtacgggaatattcttttaaaaaaaggggtaacaccgtaatctcataccggtacgcccgcatgacgcgggcggttatcgaatgatggggtgaaaaatatgaaagcggcacgccagcaagcgatagtcgacctgctgctgaaccataccagcctgaccacggaagctctctctgaacagctaaaggtcagtaaagaaaccattcgtcgcgatctcaatgaattacagacgcagggtaaaattctgcgcaatcatggacgcgctaaatatatccaccgtcaaaatcaagacagtggcgatccctttcacatccggttgaaaagccattatgcgcataaagcagatatcgcgcgcgaggcgctcgcgtggattgaagaagggatggtaatagcattagacgccagttcaacctgctggtatctggcacgccagttgcctgacatcaacatccaggtcttcaccaatagccatccgatttgccatgaactcggtaaacgtgaacgcattcaactgatcagttccggcggcacacttgagcgcaaatatggttgttacgtcaatccctcgctgatttcccagcttaaatcgctggaaatcgatctgtttattttttcttgtgaagggatcgatagcagcggcgcactgtgggactccaatgccatcaacgctgattacaaatcaatgttattaaaacgtgccgcgcaatcgttgttattgattgataaaagtaaatttaatcgttcaggggaagcccgcatcgggcatctggatgaggtaacgcacattatttctgatgagcgccaggttgcaacttctttggtaacagcctgacggaaagggtagcaggccggagacgacgccccggccttgcctgttatcgctcgtcgcgacgaccacccaccgcagcccagatacggcggacgtgcaccgtcacttcttcgcgatcgtgatacaactgccgcgcctgaatctgagcatttatgccatgttcatcaagctgtgcctgaatatacgccagattgtgtgacacttcttcgtagcgttttttcatcggcagtttgagattgaagatagtttcacggcaccagccattaaccagccactgcgccattaatgccgcaactttcgccggtttttcaaccatatcgcataccatccaggagatattgctgcgtgtcggacggaatttgaaaccgtcttcccgcagccacgtcacctgcccggtatccatcagactttgcgccatcgggccgttgtcgacggaataaacccacatgttgcgcttcaccaattggtaggtccagccgcctgggcaagcgcccaaatccaccgcccacatcccgttcgccaggcgttcatcccactcatccgcgggaataaacacatgaaatgcctcttccagtttgagcgtggaacgactcggcgcatctgccggaaatttcaggcgcggaatgcccatatagaacggcgaattattgctgctgtatgagtaaccagtatagcaacagcctggtgcaataaagaatacatgcacaaccggacgcttcggcgtttcatagttcgccagcacccccgcatcacgcaaggcagcgcgtagcggcacggtgaatttacggcagaatttcagcaactctttgctttcgttggtatcggcaacttcaacacgcagttcaccgcccttctctactacgccctgtaacatgccaacaatgggggtaatacgatcttctggcggcaaatgctgcaggagttcccccactacaaaccactggcgggcaaaaattaatgaactgaacggcagctcacggattaacttatcgccatcatcaggttgataacattcataaatcacataacccgcattctctttcacgcgggcaaaaccgaaaatttcccgctggccggctttatcggtaatttctgcggcgcactctttttcaaagcccggacggcacagcaatacaaccttattcatgacttacgcccttgcgctttaaacggatagcaccaactaacattaacgcccagcccgcaaggaagctcacgccgccaaccggtgtgacaaacgcccacaaacgcagatgggacagcgccaggcaataaaggctgccgctgaacagcaccgtgcctaacgcgaggaaaacgctactccagtaaaaccagatactgatgcgacgctgcattgccaccgcgagacctaagatcgccagcgtatgaaacgcctggtattcgaggccggtctggatccagcccatctcaacggcccccatggttttacttaacacatgcgcgccaaaagcgcccagagctacaaaaatgaagccgctaatggcggcgaaaatcagcataaaacggctggtcatggtcgtaccctacgtaaattattgttcataacgaaagcggaatttttcttgttcagcagcggctttcgccaggatccattggcgaaaggcggctattttacccagttctgcctggctgtcatgacaaaccagataaaaagcgtttttactgaccagaacatcattaaacgggcaaacaagacgtccggcctcgatttcagattgcgccatcacgttatttgccagcgccactccctgcccgtggatagccgcttgcagcaccatggcgctatggctaaaaattggcccttgctgaacgttgatatgatttaaccccaactgtcgggtatatgtctgccagtcacggcgtgacgcatcatgtaataacgtatgtttagccagatcttccggggtcttcaagggtttttcgccagtcagcagtagcggcgagcacaccggcaataaatattcggcgtacagtttttccacccgtagccccggccagttgccccgaccataaaatatcgccacatcaacatcatccgccagcttatcttcctgacgatcaaccgcctggattcgaacgtcaattcccggataagctgaattaaagctggaaagtcgcggaaccaaccaatgaatggcgaaactggggagtaaactgaccgtcaacgcccccttagcgctacgggcctggagtttacgcgtcgcttcggttaattgcgaaaatatctctttgatatcgaggaaatagctttgcccttcctcggtcagcaggagtgaacgattacggcggcggaacagttttagccccagaaaatcctcaagagacttgatttgatgacttactgcggcctgggtcacaaaaagctcttctgctgcgcgagtgaaacttaaatggcgtgctgcggcatcaaaaactcgtaaggcatttagcggtggtaatcgtttagacatggcttttaaactttgatgttaaatgaatttaacaattagatcacactgtgtaacctattagtttttttaatctgagccattataaattgtccgttgagcttctaccagcaaatacctatagtggcggcacttcctgagccggaacgaaaagttttatcggaatgcgtgttctggtgaacttttggcttacggttgtgatgttgtgttgttgtgtttgcaattggtctgcgattcagaccatggtagcaaagctaccttttttcacttcctgtacatttaccctgtctgtccatagtgattaatgtagcaccgcctaattgcggtgcttttttttaccttgcgatcgcgaattactgatccagttcgaccatctctttcacgtcagtacggttgatctgctgtttgttgccattagcgtctttatacgaaatcataccggtatcgttatcagtctgtggtttgccgtcagagacgatggtacgcccgtcattggtgtgcatcacatagttcgaaccggaacaggcgctcagggcaaaagtcagcatacaggcagaaataattgcggcagtctttttcatcatcttctccttaaagcgattaataaatcttaatagtattgattaacaggctaaaattaacgcctaacactattcagcatatgttactgacgcggcttcgccaggatatccagataattctgatggttagcactctccttgtatcaaagtgaattttgcgtcacgatcggtgcatcaagccgaggagtaccatgaacgtttttaatcccgcgcagtttcgcgcccagtttcccgcgctacaggatgcgggcgtctatctcgacagcgccgcgaccgcgcttaaacctgaagccgtggttgaagccacccgacagttttatagcctgagcgccggaaacgtccatcgcagccagtttgccgaagcccaacgcctgaccgcgcgttacgaagctgcgcgggaaaaagtggcacaattactgaatgcatcggatgacaaaaatatcgtctggacgcgcggcaccactgaatccatcaacatggtggcgcaatgctatgcccgtccgcgtctgcaaccgggcgatgaaattattgtcagtgtggcagaacaccacgccaacctcgtcccctggctgatggtcgcccaacaaacgggggccaaagtggtgaaattgccgcttaatgcgcagcgactgccggatgtcgatttgttgccagaactgattactccccgtagtcggattctggcgttggggcagatgtcgaacgtcactggcggttgcccggatctggcgagagcgattacttttgctcattcagccgggatagtggtgatggttgatggtgctcagggggcggtgcatttccccgcggatgttcagcaactggatattgatttctatgctttttcaggtcacaaactgtatggcccgacaggcatcggcgtgctgtatggcaaaccagaactgctggaagcgatgtcgccctggctgggcggcggcaaaatggttcacgaagtgagttttgaaggcttcacgactcaatctgcgccgtggaaactggaagcaggaacgccaaatgtcgctggcgtcataggattaagcgcggcgctggaatggctgacagattacgatatcaaccaggccgaaagctggagccgtagcttagcaacgcttgcagaagaagcgctggcgaaacgtccaggctttcgttcattccgctgccaggattccagcctgctggcctttgattttgcgggtgttcatcacagcgatatggtgacactgctggcggagtacggtattgccctgcgcgccgggcagcattgcgctcagccgctactggcagaattaggcgtaaccggcacactgcgcgcctcatttgcgccatataatacaaagagtgatgtggatgcgctggtgaatgccgttgaccgcgcgctggaattattggtggattaatgacaaacccgcaattcgccggacatccgttcggcacaaccgtaaccgcagaaacgttacgcaataccttcgcaccgttgacgcaatgggaagataaatatcgccagttgatcatgctggggaaacagcttccggcttcgccagaggagttaaaagcgcaggctaaagagattgccggatgcgaaaaccgcgtctggctgggatataccgtggctgaaaacggcaagatgcatttctttggcgacagcgaagggcgcattgtgcgcggcctgttggcggtgttgttgactgccgttgaggggaaaaccgccgccgaattgcaggcacagtcgccgctggcattgtttgatgagctgggattacgtgcgcaacttagcgcctcacgcagccaggggttgaatgcgttaagcgaggcgattatcgctgcggcgaagcaggtttaagcacagaaccaggtcggataagacgttcgcgtcgcatccgacctgattgtttacccctgacgcgccgctttcgccatcatcttcttcagcgcatgagaaaccgcaacaaagccaaaagtggcggtcaccatcgtcgccgcgccaaatcctgaggcacaatccatccgctttggcccttccgccgtggctttcatcgcacagacggtgccgtctgactgcgggtacaccagcgcttcggtagagaacacgcaatccacgccgagcttacctttactgtttttcactacgccaaaatcgcttttcaggcgctcgcgcaacttcgccgccaacgggtcctgaatcgttttcgccagatcggtaacctgaatctgcgtcgggtcaatctgcccaccagcgccaccggtcgtgaccagcgggattttattgcgccgacaataagcaatcagcgccgctttgggccgtacactatcaatagcatcaatcacgtacgaataaccggcattcatatattgcgctacgttatccggcgtcacgaagtcatccaccaccgttacacggcactccgggttaatctggcgaatacgctccgccattacttccgcttttgccagcccgacgttatcgcgcagagcgtgaatttgccgattggtattggtgacgcacacatcatccatatcgataagcgtgattgcgccaatccccgtgcgcgctagcgcttccgccgcccaggaaccgacaccaccgataccaaccacacaaatatgcgcgtcagcaaacagttgcaatgctttttcaccatacagacgcgctgtgccaccaaaacgctgacgccatgcatcactaattaccacagacatagcacctcagaattaaaaagggtgaggttacccctcaccctgtcatatccgtaaaaacggcatacagaatatcacatcagccgctaaagacgttacctgcgcccggggcggttttcagcacccagacacgtccatagtggttgtaccaacctgcgcggtgtccggcttccggcccgatcccttgatagatatcgaagtgttggcctttgattgcgccaccgacatccagcgccaccatcagacgcaattcgtactgaccgttaaatttgccgttattatccagcagcggcacttctgccagcaaggtagtacctggcggaataattgaacgatcggaggcaacagaagcacggccaaccagcggcaccgcacttgcccctttcaccggtgcaaaagattgcggtttaaagaagacgaaagacgggttctgttccagcagctcgcgaacctcagcttcactgtgtgtttcgccccagtgacgaatcgcctgcatcgacatatcttcttttttcacttcgccacggtcgatcaacaccttaccaatgctgcgataggcatgaccgtttttccctgcatagctgaaaaagttaagcggactgccatcaccaaagtcgatatacccgctaccctgcacatccataatgaagttatccatcagggagttactgtaagcgagaatatatttatcactcagcgctcctgcgtagatctccgcacgagacggcagacgaccacgttttggcggcatacggtaaatcggatactggaactcgccctgacgggtatggcgcgcctgaattaccggcgtgtaatagcctgtaaactgcacgttaccatagttgtcgacaccttccatctgccaggcatcaatgccgaactggcgcatattgcgggtatcaccgcctgcgcgcagccactcttgcaccgcgttataaacattactctggttgccatacagacgcggtgacgaattacggatatggttaatttgctcggcaaaatcaccggcattaatcggcgcgccaacggcatctggctggttcaccagagagaaaggctgggtaaatttcccgtctttatattgctgtccgcgatcggttggtttggaagagcaggcggcaagcattgccacaaccgtgcccataagaaggtactttacccaacgtcctttcattgttctcttcttcaggttaaaaaataaggcgcaacgaagataacaaaccaccgcgtttaatgaaatgagcagcctctccctgacgcaaattttgcacaaaaaacaggctttagtgatttgtttttgttcaaaatcatgccgaatccgtgatcggggtaaaaaaaaggttgcatgaaaacgcgagcggagtatagtgcgcatccacggacgcggggtggagcagcctggtagctcgtcgggctcataacccgaaggtcgtcggttcaaatccggcccccgcaaccaattaaaatttgatgaagtaaagcagtacggtgacgcggggtggagcagcctggtagctcgtcgggctcataacccgaaggtcgtcggttcaaatccggcccccgcaaccaatcaaaatttgatgaaataaagcagtacggtgacgcggggtggagcagcctggtagctcgtcgggctcataacccgaaggtcgtcggttcaaatccggcccccgcaaccaatttattagaatgctgacaaaccgcaatgtgttctacaaattgcggtttttttgtatttaaaatctttgttcgctgaactcacaacacgttttttatctcccttcctgcgaagtaatcaattatcgactgggcaacgtgtatcccggtttgctggtatgactcaacggtggcggccgcgatatgcggcgttgtaatgatatttttggcatgtagcagtgggctaaattgcgccaacggttcagagctaaacacatccagcgccgcaaacacatttcgttcttcaatcacctgaagtaaagcgccctcatccagcaactttccccttgcggcattgatgatcagagcaccattgcgcatcatcgacaaatatttatgactaatgaagttctccagctcagaagaaaaaggcaaaagaacaatgatgacatgcgactgcataaagatatcttcaattgatacaaactgaactccagctttgtcagcaacctgatagtcgggttgtttgtcaaaagctaaaagctcaacatcaaaaccggataaccttttcgccagagttttacctatattaccgtagccaaccaggccaatccgtttcccttgtaattcacaaccatgcgactccccccagtagccattttgcatcgcatgatagctgccagggatatttctcatgctcgcgaagataagtccaatgataaattccgcaaccgcatttgaattaatcccaaccgcattattgacaacaataccggattgctgtgccgcacgaagatcaatattgtctatccccgtcccgaatctcgatattattttcacaccagacagcaatgatagcgtgtccgcctgataacaatcttttccggcgatgaccgcgcaaatagattctcgtaatgcagtggattctgatttaagcagatgctccacattattcttaataataagattaaaattattctctcttagcaacttgctggcggaaacacagcgtgctgaaaagctggggacggtgaccagaacatttttcatagctgacactcacttcaaagaacgccaccccaaaagatggcgtgaccggttactgtatttatattttgaaattatgaatttgctttaatgccgagtgcacctcctggatgatataagccgaaatcagcacgagtaaattttttcaattcagagagtgcaagcgccaccgcatcaccaacaaccagaacaacagtcgacgagcatgacggtgctaaacctaaattatccgcctcacttttgacggggatttcaacagataaatcacaacttatcgcaagcgatgagtgatgactgcgggtaaaagagatcaaataattacccatttttttcaaactaggcagtgtcgccaggatttccgccgtctcaccactgtttgaaataagaataacaacatcgtctttcgccaccattccaaggtcgccgtgtaccgcttccgtaccgtgaacaaaaaacgagggagttccggtgctggcaaatgttgcagcaagttttctggcaataatgccagatttcccaacaccaataaaaacaacttttccctggcaagattgtaatattttaattaaatttgcgacctccgaaagaggggaatcaataacttcttcaactgctttatgttcgttacgcataaaatgtttaatgagatggataagatccgtgttattcatttttattctccctgattaatatttttaattacactcacaagacgcgtaagccccatatataatttttctcgaccgcaggccaggttcagacgaaggtagccctccccctccgttccatagacatgccccgccataatgcccactttgccttcatgaattaatcgactgtagaattcatcaaaaggataaccaatagcagaacaatctatccaggaaaaatagcaaccatcagctggccttacgatcaattctggaatattttcattcagatactgctgggtgaattgaatgttagaggctatatgtgcctttaatgactttaaccatccctcacattcgttgtaggcaataatagttgcaattatattcagtactgatggggagtttacaaaatcgcgatacctcgatatcgttctgaacttatgattaaaattatcgtcagttgaaatcatatacgatcctgttagtgcaggaacattaaatgttttcgatatcgagttaaatactactactttttctttttttattttaagcgcggatgtaaagctacgattaaaaacaaaatcactatggatttcatctgaacataaccagacattatgccttgtacagcttgcagcgattttatgcagttcttcttccgaccagactgttcctgtcgggttatgaggattacataataacatcatctttgcgcttttaatcttaagatcaaaatcttgccagttgatagcgtagcccccctcattttttataatcaaagaggctgtcagaatatttcgctcgctatgtttaattacatcaaaaaatgcattatagacaggtgtaaaaacgagaatattatcaccatgcgatgtcaataactctattgcttttgcaatagagtacatcacactggggctataggttatccattcaggtttaatatctgtttgatattgttgataataccagtttactatcgcattcagatattcaccatgttgccaacgactgtaccctaaaatcgggtgttccaggcgtttttttaacgctctggtgatagcgtctggtatcggaagatccatatctgaaatagagaatggtagtatatcttttacaccaaatctgtcctcgcaaaagtcccattgggtacaatatgttcctttgcgggaaacaggagtattaaaaacatccatcagtatatccccatatagttatccatatcccgacgcagggcgatgactttagtgccgataatgacttgtagggtattttgatcaagttttacaaccgcaatcccgccagctctttttattgcaacttcgtcaatcaatctcatatctgcgattgttaaacgtaaacgagttacgcaattatccagtgacttaatattctctttaccaccaagtgccttaaccatctgctccgccgcttgcagctctgatttatcaggagttgggatatccgctatagccgtatcttcgtgagcgttcagcgtgacaggactggactcttcacggcctacggtcatcaggttaaatttaagaatggtccaacggaacacaaagtaataaatgaagaaataggccacttcgacacacaccgcgatcggccaacctgttcttgtgccacgcaatacgccaaagctaataaattgaatcagatcgccagtaaatcccatcttcacgcccatatatggcagaaccatgttagcgaatccattcataaaggcatggaagacaaacagcagtggactgacaaataagaacagaaactcaatcggttcgctgacgccgccaataatcaccgtaagcaccccggaaataagcaatgctttgatagcctttctgttttgagcatgagcagtgcgatacatcgccagcgcggcaccaaccagaccatactgaatcatcagtttgccctgctccattttccccgccaaatccagcggaatgaccgcattctctttgacgtatgccataaacatgttcagggtgccgtaatattcttcgccgccaatcacagccgaaccgccgattggcgtaaagcggaaaactgacgtcaccagatggtttaagccaaaaggaatcgtcacgcgttcggcaactgcatagaagaaataaccaacaggaccggaagttgaaatccagtgtccaatgagcatgaaaagattgaaaaacggcggccagataaaaggaatgatcagaccaaatccactcatcacaatcagtgtaatgataggcaccagacgtgggccgctataaaaacctaacgattcaggaatgcgtaaattaacgatctttttatacatgctggcgactaataacccagcaacaattccccccaacacgctggtattgtaggactggatccccagaatgatggtttgcccatgtgtcgacatttggtcagcaacgaccaataagtcgtgctgtttaagataaaagttcgttcccagatgcatcgccataaaaccaattaagccagaaaaagcaccataggctttatcctctttatcttttaataatcctaagggaatcgctatcgcaaacaatacaggtaaattaacaaaggcaaacaaaccaagactaacaatgaaatcaagtatggttttaattattggaatagccagaaatggaattaactttgccatatcatcactggctaaaccacttcccagccctagcatcatgccacatacacttagcagagcaatgggatacataaatgccttccccaggctctgaaaaaaactccaggctttcttttgtttcatgtgggttatctcatataaatgttatatataattagtccattaatactttggtacgaatagagagatatagtttttcttctaaaattaattcatatttaaaagtggcatacagataccgttcaatttcatgaattgcgcgctgtaacagaatgtccttttcaagaaactgttcatagatatcaccaatatctttctgttttattttttcattgcataacacgcgacttgaaaaatatttaaggtgcatcataaatctggaatagttaaatgaacttctgtccacctttctgttataaacaacttcaataagctccgtgattatttgcgacaactcaataatccgtactgattcataatcaactgaattttcataattatttaaaatatgcaatgctataaaaccaatctcatcatcaggaagttgaacgctgaattgctcattaatgatagttaatgcatcgcgacttatcgcatactctgctttgtacaacgctttgatttcatcaaggaaaacattattaatttgtatacctgaaacgactcgggatattgcattcgaaatgtgatccgcaagaatcaatagtagcgatggattgagatttttttcgagatttttctccgcatattgcactattttttcggcaacaaacacatactcaatatctacatgttcaatcaatttataaagtttgtttttttgttcatttctgacataaaaaatccggttagccggatgctcagggaccgacattccatattttttgttgtaaccgacgccaggcccagaaatgataacctcctgtccattcatcgatgcctgtacacaattattgttcatgactttttcgatgatcattccatggctccaaaaaaaaaggcaaggcacgtcagaagtaataactacttcaaacattgccttgcctgatttaacagttacaagatgattaactaatgcgtatacattacacggaattgtgcttaattaaagagatggtcggcttatttttcaagccgacattcaaatatccgacatcagtcacaaaaccagcgtctaatattcaggtaaatgttatctattcaacgaaatataaattcattgaataaataaaaacattatccccttctcgccagcgtcgccccatcggcaaaatacgctttaattcccgcaagaatagactccgcaacttcctgctggaaagtcgccgttttcagtttacgctcttcctcaacgttactgataaacgccgtttcgaccagaatggagggaatatctggtgcctttagtacggcaaacccggcctgttcaacttgatttttatgcagcttgttgattttaccgagcttattcagcaccgctttaccaaacttaaggctgtcggcaatggtcagcgactgcaccatatcgaacatggtgtggtcgacatagcggtcaccgcttttgcttacgccaccaatcaagtccgaggcgttctgggtttgtgccagatattttgccgcagtactggttgcgcctttggttgagagcgcaaacaccgaggaaccgctcggctggcgactggtaaaggcgtcggcatggatagaaacaaacaagtcagcgcgctgtttctgggcttttgctacgcgcacttgcaacggaatgaagatgtcttcattgcgcgtcatgtacaccttcatattgccctctttctcgatcagagagcgcagacggcgagctatttgcaataccacgtctttttcgcgcgttttgtatttccccaccgcaccggagtcttcgccaccgtggccagggtcaagcataatgacaatcggacgatcccgcccagctttacccggttgtggaccactttgtgctggcggcacctgcttttcgaggtcgcctttgttgtaatcctccagcagcgccagcagcgggtcctgcatatcctgtgcattggccggatagaggtccatcaccagacgctctttaaacccggcgaccggcgcaagggcaaacagctgcggttttacgttttgctttaattcaaaaaccatacgtacggtttgcgggtcaaattgcccgacgcgcgccgacttgatgaacgggtcgtcagcgcggatttgcgcagccatccccttgagcaccgagttcaggtttacatcttcgatatccaccaccacgcgttcaggattactcaacgcgaactgcttatatttcagctgacgatttgattctaccgtcacgcgggtgtagctggacgcaggccagacgcgcaccgccacgacctggctgaccgcagccaggctgacctgacttacgctcaatagccacatggcacccgcgccttgcagtaaacgacgacggctgattgcagtgttggatcctgacatgcctctcccgagcaaaagaaatctaagctgtgtaacaagtaaacgaccaatttgaccggaaactttagcgaaagacgcataatctgtcatctaataaacggtaaacattctttttatattcacggcattactgataaaaaagtcgctcccgcataaaatttacacttgcaccctgcgaaaaaacagaataaaaatacaataatttcgaataatcatgcaaagaggtgtgccgtggtaaaggaacgtaaaaccgagctggtcgagggattccgccattcggttccctatatcaatacccaccggggaaaaacgtttgtcatcatgctcggcggtgaagccattgagcatgagaatttctccagtatcgttaatgatatcgggttgttgcacagcctcggcatccgtctggtggtggtctatggcgcacgtccgcagatcgacgcaaatctggctgcacatcaccacgaaccgctgtatcacaagaatatacgtgtgaccgacgccaaaacgctggaactggtgaagcaggcagcgggaacattgcaactggatattactgctcgcctgtcgatgagtctcaataacacaccgctgcagggcgcgcatatcaacgtcgttagtggcaattttattattgcccagccgctgggcgtcgatgacggcgtggattactgccatagcgggcgtatccggcgtattgatgaagacgcgatccatcgtcaactggacagcggtgcaatagtgctaatggggccggtcgctgtttctgtcactggcgagagctttaatctgacctcggaagaaattgccactcaactggccatcaaactgaaagctgaaaaaatgattggtttttgctcttcccagggcgtcactaatgacgacggtgatattgtctccgaacttttccctaacgaagcgcaagcgcgggtagaagcccaggaagagaaaggcgattacaactccggtacggtgcgctttttgcgtggcgcagtgaaagcctgccgcagcggcgtgcgtcgctgtcatttaatcagttatcaggaagatggcgcgctgttgcaagagttgttctcacgcgacggtatcggtacgcagattgtgatggaaagcgccgagcagattcgtcgcgcaacaatcaacgatatcggcggtattctggagttgattcgcccgctggagcagcaaggtattctggtacgccgttctcgcgagcagctggagatggaaatcgataaattcaccattattcagcgcgataacacgactattgcctgcgccgcgctctatccgttcccggaagagaagattggggaaatggcctgtgtggcagttcacccggattaccgcagttcatcacggggcgaggttctgctggaacgcattgccgctcaggcgaagcagagcggcttaagcaaattgtttgtgctgaccacgcgcagtattcactggttccaggaacgtggatttaccccagtggatattgatttactgcccgagagcaaaaagcagttgtacaactaccagcgtaaatccaaagtgttgatggcggatttggggtaagcgatgaaaatcgtcggatgcgacatgcgtaacactcgtgcgtcgcatccggcaattacgtttattcccgtgaactaaacaacgccgccagaccactgcgccgctcagtacgagtggcgattgccgcacttaatatgcgctcatcggcatacagcgacagacggcgacgcgcgcgggtcaccgcggtgtaaaccagctctcgtgttactaccggcgtgcgttggctcggtaaaatcaacgccgcatggtcgaactccgatccctgcgatttatgtaccgtcatcgcccacgtagtttcgtgctctggcaagcgactcggttgcacagacttaatattgccgtccggcatcgcaaaccagacgcgcgtcccctgcccacgatccagagcgataccgatatcgccattaaacaacccaagcgcgctgtcattacgggcaatcatcaccggtcgaccttcgtaccaacgagagtgcggatgacgatgaattttgcgcttctgttgcataaactgctcaattcgctcattcagtccagccacgccaaacggcccttcccgcagggcgcacaaaagctggtactcattgaacgcctgaatgattaaatctggctcggcacgcgcttgcagcagatccagataacgtccgtaacccgcaagagcttcctcaagcatcgcaatataatcttcgccgctctgtaaaagtcgtttttcgatatcagtaaaatcctgctgaaaaacggttttcactgccgttttatcaccacggttaatcgccgcagctaactgaccaatgccagaatcgctgccgaaacgatagcttttttgcagcaggcaaagactgtcgcgtaaagatgctgcttctgtaccagttcctgccggaacatgacttcccgtcagacgacttaattgcccggcacgctcggcggtaaagccggcattggcataagcacaaatatcgcccagcacagccccagcctcaaccgaggccagttgatcacgatcgccgagaaagatcactcgcgcatgatcgggcaaggcgtctatcagtctcgacatcatcggcagatcgatcattgacgcttcatctaccaccagcacatcaagatgcagcgggttaccggcatgatgacgtaaacgctggctacccggctgcgcacccagcaatcggtgcaaagtgctggcatcttccggaatgcgtttcttttgttcatcggtcagcggtaattgtcgcaaagccttgccgagagattcggttaagcgcgcggcagctttacccgttggtgcagccagacggatacggcagcgttcgccgtcggccatttgaattaacgctgccagcaacttcgctacggtggtcgttttaccggtgccagggccgccggaaatcaccgagatccgccgcgtcagcgccactgccgccgcaactttttgccagttaatttcatcgcttactggaaaaagtttgtccagggtttgcgccagtagagcttcatcaacctcaatggcatgattcacttcgttgaaaaagcgtgccactgtgcgctcgttacaccacatgcgattcaaataaagacgatcgccacagaggatcatcggcgttggttcatctccccggctgaccgcttgtgaagccagcaagcattcttcccaattttgtagctcaccgatttcactgacacaggtcgccaacagcggatgcgatgcctcgttattttccagtcgtgaaagcggcaaacaaacgtgtccctctccggcatcatgacttaacagtgccgccgcgagggtgacggcaggatgttcatctcccgccacggtcagggcaaactgcacgtccagcgggcgtagctgtttgtgctccacagcttccagtaattgcttttgcaatttcattacgcctcctccagggtcataccggcaaacatctcatccatcaggtcaatcaacccggcgttgggtcgggtcacgtagatcccttgttgcggatgttctttatcaacgccacgcaggaacagataaataacgccgccaaagtggcgctcatagtcgtaatcagcaatacgatggcgcagataacggtgcagcgccagggtataaagctgatattgcagatcatagcggtgtgcctgcattgccgctgccatagcctgttgggtgtaagccgaactgtcttcacccaaccagttggatttatagtcgagcaggtaataacgcccttcgtggcggaacaccaggtcaataaagccttttaacattccacgtacctgcatgaactccagcggcgggcagccagcggatagcgggtcaaactggcgaattagtgcatcaagctggctggcgataagcggttcactaatcggcaggtaaaactccatctccacctgtttatcgcgatcggaaagctgattcaggctaacacccgtttcattgagaggtgcctggaggacagccgtgatccactcagtcaacaccggttcccactgcggttcaaagccgccgagctccagtttttcctgtacccagttcgggtcaaccggctgggtaaaatcgaggtcttcaaacaaactgtgcaagaatgtccccggtgacgcaccgcgcgggaactgatgcggtgttaacgtcggttcttcaacgacgctgaccacgcctgcggcatcaacatccaaccgtggcatcagatcctgagcgataccgtgaccacgctgctgcaaaccggagtagctggtgacacgccagttatcgccgggcaatcgttgtagcgtcctcgcattcagttctgcagttaatgcatcattaacctgccagggctggttatcaccagtttgtgccgtttgccaggcaatatcatcatcgcataacgcttcaatacaggtgcgaagccctgccgcatcttgcggttcccctttttgcagcaaacgcccgagcgcactttggtggacgtcggtatcaccttttttatcgccacgacggcgcaccagcggtgcaacgccgagactgcaatgccaaaccgaacgcgtcagcgccacgtaaagcaaacgcagatcttccgccagacgttcggcctccgcgaggtcgacgctttctggcgcagcattaagatccagaacagcctcaaacgagtggcgatcgtgataaaacgcctgatcctggacgcggaaattggtgataaacggcagccagaccaatggatattccagccctttcgatttgtggatcgtgacaatctgcacgagatgtttatcactttcgagacgcatttgttggctggaggcattactgtctggctcgaggatatgttgcgataaccagcgtaccagcgcatgttcactttccagctgcgtgccggcttcttgtagcaattcgctgatatgcaagatatcggtaagacgccgctcaccgcctgctgttgccagcaagttttctgcaatgttacgcgccgacatcagcgcccgcagcatcggcataacgccacgtttgcgccagatttgccgataaccatcgaactcttcgactaccgcatcccacgcatgttcgtcattattcagcgtttcaatatccagcgcattcagccccatcattgacgttgccagcgcactgcgcagggtgttctcacgttcgggtgtcatcaccgcctgcaacagccaaagcatctcctgtgcttccagagtttcaaaaacactgtcgcggttcgaaaggtaaacggaagggatttccagcaacgttaaggcatcgcgcacctgggcggcctcctggcggctgcgcaccagcacactgatgtccgaagcacgtaccggacgtgcatcatcgccgttcatcagcaacgcttccccgcgctgcccagcctgtaaccagtcgcggatttgcgcagcacatacctgcgccatggtactttgatagtcgccaacgccgcagctttcgccttccatcagccacattttcatcgcaggctgcgtttcacctttaaacacaaaacgtaacgcctgatttttcccggctgatttcacaggaataaacggtatttcgcgaaacatgaacgcgtcatcagtctggctgaaaagcttgttcacactattcaccattcccggtgcggaacgccagttggtgtctaaagtgtagtgggcgtgaacttcgctacgcgccttcatataagtgaagatatccgcaccccggaatgcatatatggcctgcttcgggtcaccaatcagcaacaatgcggtttccggctgatggtgccagatacggcgaaaaattcggtactgctgggggtcggtatcctgaaattcatcgatcattgccaccgggaatcgcgtacggatcgccgctgccaacacctcgccgctttcgctacgcagcgcggaatcgagccgacttaacatgtcatcaaaacccaattcgccacggcggcgtttttcacgcgctactgtttcgcggatctcagccaatgcgcgggtgatcaccagatcgcggatcgacaatggttctgcaagcagttgatcgatcgcctcaaacagtggatgtcgcggggtttcccccccggctttcgtgcgatcttctaagaaacgctgagagaatttttccagcgactctggcaactgataactgttggtctcttcttctgcccaggcgctgatcttgtcgatccatttagcctgattgctacggttaaacttgcgtcgatcaataccagaagattcgatcagcgcatccagttcacccaccgcgtcgcgccactgctgttttacggcgtcgatacgcgccacaatttgcgcgtggcgggaagccagcgtttcatcatcgggcggcggtgctttgataaccggtgcttcgccttgcagataacgattaatatcgcgcagcaacgcctgcggccctttccaggtttcaaagaccacctgggcaatttcacgcgtcagcgggtagcagtggcgacgccagaaatcggcgcaggcctggtagcgtagcagagactcatcttcaatcagctgctgctcaaacagcatgccggattcaaaggcattcaggttgagcatgcgctggcaaaaaccgtgaatagtaaagactgccgcttcatccatctgccgttcggctaacaacaaccactgcgcggcttgccctttatcgtcgatctcttgcagcagacgtgcatacagcggattgtcagtggtttcacgcaggcaggcgatacgcaactcgtgaatattgctacggatacgaccgcgcaattctgccgtggcagcctcggtaaaggtgaccaccagcagttcttcaacggtcagcgggcggggaaaggcggcggaaccgcctagcccaagtaacaggcgcaaatagagcgctgcaatcgtaaaggttttgcctgtgccggcagaggcttcaatcaggcgctcaccctgtaagggcaagcgcaaaggatctagtgtctcggcgacatcactcattcttttcactcatcaggggcattgtttgctgcaacgcgctgacgttctcccacactttccagccttcaggatgcacatattcggctttcccgttctggctgccggaaatctgcgacagaatagccataccttgcggctcgaccaccgcctgatggaagaaatcagcaagtttttgcggcgtcagcagttttatctgggccacgattttatcacgcgaatcgaagcgcatattgccgcgatcgaaatctttacttaacttcgatgcttcttcgccgagcgtttgcggtgcctgcagcatctgggttattaccgcctgctggatttgcgcaaactcttctggcttcatcgtccgcaattttgcctctgcggttgggaaaaacgccttgtaacgctcccacaagaatgaaggctgtttatcattgctttgcaaaaggaagcccatgccccactgacgccccacgctcattggaaacgcaaacacggcatagcccaactgttcttcggtacgcaactgattgtagaaccacggctgtacgatctgccccaacagagagctataggctgagctggtgtattcatcgtagccagtcggtacaaatatcgctgccagtgcggagtcggtgctgttaccagctttttcaaagatgacggattgttttttatcgaccacgacatctttgttacgacaccactctgaaccatcagcgcccaactgtttttgcacatggcgtgccagcgttgttgcctgggcttcagtcatgttgccgataaccataaactctggtctagcccctgattttaaggcgtcgcgataggccagcacctctttcaacgtaatggagggcaaaattttgcgccgttcatctcgcgagaagtacggcacttgcgagagcatctgcgcgggcataatcgcctgctcaaacgctttgcccttttctgcggaatccatcatctggttataccaggacttcgcctgctcaagctgatcttccgtagcggtatagctaaagtagccctccagcagagcctggaacagctgcggcaggcgctgagtgtaaccattggcattaaccataaggccgttgttagcattggtggaaaaacttatgccaccaaccgacgcctggttgcttaactgatcaagcgccagccctgcgagataatcattgagcgcaaacatcacctgattgcgggcgctgtccatggctttcggattacgcaaaatcaggctgacatcagctttgggctcactggcaaaataacggcttggcgcatacaccacgcgcagattcgactcatcaacaatcaactctggatggtcgtatttcttctctgacttaatcagcgagaaatcgtcaggaatataggggttaagctccggtaaggagagcgcaatattggcggcttttttctgccagtccgcgaaagtttgttcgctgattttatcgacttgatacggcgcatcgacaaaataagccgttttattgtgcggctctttcgggctgatataccagatacgcgcattctgcggcgtcatcatcgccagacgttcttttactgctttagcatcgtaccgatcggcaatattgactgcatccagtgtatgctcaacaggaacgcgaatcatggtatcagccagccattcgacgtaatccatatcacgggtgattgacggataacggaagtcgatatccagcacattcgccagttcatcgaagtattgtttatcgatccctttttcacgtaacagattgagatagctaaaaatggccgccacaacctgatcgcgattcgccagacctttatcggttaaagacgcagagatcgctaatacgccgctgttgccgttgacgataggatcggaattggcgctaataccctcaactaatccctgcttttgcagccagtcagaaagtgtaccagggctgcgattaccaatcagataggtaatcaattcatccgttttactacggaacttcgctgaattgttatcgatgcgaaactcaacgcgcagaactttacgcggcaacgccgggacgtaatgaatgataatgcccttttgcgcgtcggtgactaccggcacggtgatttccggttttttgctctctttgttcggcacgcgaccaaaggtgtccgccgccattttcgccaactccggcaacggtttattgctgtaaataaccgccttcatcagattggcggaatagtacttctcgtggaaatctttcagcgcctgctgtaccggattacctggtttgtcgcttaaagtttcgaggttaccaccagaaaactttgaaccggggtgtgccgggttaatggtttctgcgctgacctgtgccatgcgcatcccgtcacgcgtacgcgccatggttaattcggcattcactgcattacgttcacgttcggcgtatttcttgtcgagcaagggttctgcaatagcgtccgccaggcggtctaccgcaccgggcaaggcgtcgttctcaacttccagatagaaagccgtgcgatacggtgccgtgctggcattgtgactgccgccgtgcattttgagatattcggccagactgtcagcctgcggatactttttcgaccccatcagactcatatgttcaaggtaatgtgccagcccctggtacgcctcaggatcttccagcgacccaacgggcaccaccagcgccgagagcgatttaactgcctgcggatcagaaaccagtaagaccaccataccgttatccagacgtatagcctgatactggcggttatctttatcacttttacggatggtttcctgaatcggctgccatcccgtttctgcctgacttaagggtgcccagagggcaacaaacaacaataatgctttgaaccagatgctgcggggcattcacagacctcataatcaactttattttctggccagattcaacacgttaacgcaaatcatctgccagaatttaatcttgtgctgaacgagtcagcctatgtctatataaccatcagtccgtgactggtgcgcatcataaagtaagcggatagattgcgcaatttttatacaatactcatgactgattaaagcgaaacagcggtaacaggaaacgttgcgactgttcaacgatagcctccattgtctctggtgttaattgccgccagagccgttgataccagatatcatcaccttcgccacgcaccatcatgttgccttcgtaagcctgaaggaatttcgtacgggctttttgcaacgtggaatcgtcatccagcatggcatcgttttgcgcgtcataacaggtttttagccacgcgccgccactttcaggtaacaccagcaatggcgcggacattccttcacgatacccttcaatcagctgtgagaggtaatgtaaagcctgttcggctgcaagcggcggaaaacgccactcgccgtctttgcgtagaaaaaggcgactttcaccattaccaccgctggcacagtagacaaggtgttccagccaaagttgcattccctgcgccacacttaataaagagggacgccaacgcaacaggccatccggctgcacctgcggcaaccagccagttatctgcacaccgttgcaggcgagatcgatttccatgctctgccctggctggcgacaggcaatgactctgtcggcaagttgctgcatctcctgacactgcgtttcccagaaaatttcaccaaaggcaccatacggcaaatcacctgccgcccggaatcggcggaacaagcgttcggcatcatcctgctcaaccagtacatttaataactgctggttgatttgataacgactaagcccttcaagaataaaaggttcggtgtcaggaatttcgctgtcttcggtacggaagttcacctgcaaacgcatctggaaaaacgcccgcaccggatgtgcccagaatcgttgtagcgtctccagcggcacagtttccggcaaggtaaacggcagcggctgaacaaattcagaatgtgctttaccagcctggctggccgcaggtagccactcgcgcgcatagctttgtaagttaccgggctggtagttttgcgggtcaaacggcatccgggtatggtggcaagtaagatgcgcttttacccttgcctcgctttcatcacagttaagcgcttcatcgcccggtagataatggctttgcccgatgtagtcgatcagttcctgcaccagtaccgacgggaaacgttcactgttatcctgaatggaacgcccgatatagctgatatagagtttttgctgcgcggaaattaacgcttccaggaacagatagcggtcgtcatcgcgacggctacggtcgccacgcttcggtttctggctcatcagatcaaagcccaatggcgcaagctgacgtggataaacgccgtcgttcattcccagcaggcaaaccactttgaacggaattgaacgcattggcatcagagtacaaatgttaaccggtccggcgagaaaacgctggctgatacgttcttgatccaggcgctgtgccagttcatcacgcaatagtgacagcggcaccgcgtcgccatactgcgcacctaaaccttcggcgataatcgcctgccattgttgttcgatcagcgtcatcgctgcttcggtttccgcatccggcaggaagaaggcgttgagcatatcgcgacaaaccggcaaccactcttccagcggacgctcctgcgccagcccgcgacgccagatgtttagctgcattagcagtgaagacagatgccccaccagttctgcaattaagccgctcgattcatcataaggtagaaccgattgccactcgccctgcgcgctctccatcgcgtagcccagcaacatgcgcgtcaggccaaaccgccaggtgtgttgaccggtagcgggaagttccagctcgcgaacgttgtcgtcatctatcccccaacgaattccggattcgttgacccactgacgtaaataacgcagcccttcttcggtgatgtcaaaccgcgctgccagcaccggcacatccagtaatgccagcacgtcttccgacacaaagcggctgtctggcagcgataacaggctgataaacgcttcaagtacaggatgcgactgccgcgcccgacggtcggaaatggcgtaaggcaggtaacgatccgcaggtgcgctaccaaacacagcctgaataaacggactgtagctgtcgatatcagccaccatcacgatgatgtcgcgcggagtaagtgtcgggtcttcctccagcatcgccagcaggcgatcgtgtaaaacttcaacttcacgctgcgggctatggcaaacgtggaaggtgatactgctatccagtggatcaagcgggcgtttgttatcgctacgggaaaactcttcgatgttcacaccagcaacggcgcggttttccagttccagaatgtcagactgaatattatgcagcaggttatctggcgtcacatcgacaaaagcgtccagctcctggctgctctccaggtcagaaaggagataaatgtagtcgcgcccaagcttgccccatgaagccagcagcgggttgccgacatcctgttcaccatcgctgttaaagagctgcccggcattttcgctgtcgcgaaatagcggtaattcgcgatcttcaaaactgtgtcggcgctggcgagtcagtagtttcgccagataagctggatctttaatgtcgccccagtaataacggcaggggttggtaaacaggagatggatttcaatatgtttacccagcgcctgtagcgcctggagataaacaggcggtaacgcggaaataccgcatataaagacgcgcgaaggtaaccccggcgggcaggtcgtcgcggactccagcgtttcgataaagcgctgatagagattggcgcggtgccagcgcggttgcccaagttcgtcggtatattccaccaacgccttccacaacggcgcttgccaagcctgtgcttctcccaacccttctaccagatgtcctgtttcccactgtgccagccagtccggacgatagaccagatactggtcaaacaggtccgccgcttttgaagaaagctggaacagttttcgcttgtcactatcgtcagtcagataatgccgcaacagggtaaagtcttcgcgctccaacagttgcggcagcagagtcatcagtttccagctcatgctctgtttgttaaaggcgctctctttggggatctccggtaacacccggacgaacatatcccagataaagctcgctggcagcggaaaatcaatgtttgccgcaataccaaacttttgcgacagggtcatttgcagccactgtgccataccggtactttgcaccagaatcatctctggttcgaaaggatcgtccagccgttcgcgttcgacaataaactccatcaacgcttccagcacgtccagacgattggaatggtagacccttaacatagcggctcctgactactgacgattcgggcaatgcaggcgggtcatctcgccttctctgcccccgggtgaaactagcgtaacgctgatgctgacacatcccgcctgcgatgtctgcattcggttgacctgccagttagcaggtggcgaaatcgcgcgcagttgcgtttgctgccagccatgccgccagagctgttggtactggtttctgctggcaagactgttcattaatgttcgctggaaacccgataacgcagtgacaatcatcaccatcaacaccatcgccaacattacctccggcagactaaagccttgttgattcctcagggaagctgacataacgccctctctttcagcggacaaaaatcgctccagccgcgtggcgaaaaaacaatgtttccatcgatgacttcgcctgttcgccacaacgaaacgccttcataaccagcaatcaataaggcttcattatctgccagtaaacgcagacaaacccgggcaccggtggcagcatacagtaagcactgaactgcgggctgcgtctgccaggagtgcatttttccccactccagcgccgactgaacgatggcctggcggcgcaatgactgactttccatgctcacgcgagaagcaaaactgcgatcctgctgactcattccttgcaatagcaagctacccaaaatcagcagcatcaggaccagagccagtgacgaaacacccttttcgcggttcacaggttggatcctgtcacgctatagctggcatccaccacggtttgcggatcagccttgctggcagcgtgcatattaaccgtcaacaccggcgagaagccgctgacatcctgacgtacgacctgaaaagtgtcgataatgatggcatccggattagtgactttatcccagcccttaccttcacaggatgtcgcaccgcgtagcgtttccagcacatgctccttcagacgaaatccaatctggtcggactcttttaccggttcgcgatcccagataccattactgttcgcatcccactgcacaatgacacagtcaccctgtccgacaatttccagcccttcgcccgtacagctgccatggcaataacccgccctctggagatgcttcgcgacggtaaatacccgcagccagatttcatcttccagcgccagcttacgggtgttcgttaaactttcacgctgtaacgcaggcagaaagcgtgcagcccccagcaacaatacgctactgatcgccatagcaatcaacacttccagcagagaaaaaccttgctcttttacaggcatccttctgtttctccttgctgacaaagccggagtcttccccacggcgaaaccaccagccaccactcgcccgttgagtttttgaagcgaatatgcccggcccatgcggtattgcgcaggccaaagaaagcaagcgaaggtgtcaggtcgctcatttcgacttcgggccagcgcggcacaaagaccaatggtgaactgccatgacaggtattcgccccagcaacggaactcacaaggcaccataacgtcccctccctgataagactgatactgtggtcgcggttatgccagttggcatcttcacgtaaatagagcaaatagtcccgcgcctggctggcggtttgccaaagccgttgcgactgctgccagtattgccagccataaagcccacttgcgcttagcatgaccagaatcagcatcgcgaccagcgtttcaatcagcgtataaccacgttgtgttttcatgccggcagtatggagcgaggagaaaaaaagacgagggccagtttctatttcttcggcgcatcttccggactatttacgccgttgcaggacgttgcaaaatttcgggaaggtgtctcgaagaatttaacggagggcaaaaaaaaccgacgcacactggcgtcggctctggcaggatgtttcgtaattagatagccaccggcgctttaatgcccggatgtggatcgtatccttcaatctcaaagtcttcgaaacggtagtcgaagatggattcgggtttacgtttgataatcaacttcggcagcggacgcggttcgcggcttaattgcagatgagtttgatccatatggttgctgtagagatgcgtgtcgccaccggtccagacaaaatcacccacttccagatcgcactgctgcgccatcatatgcaccagtaacgcgtagctggcaatgttgaacggcaggccgaggaagacgtcacaggagcgctgataaagctggcaagagagtttgccgtctgccacatagaactggaagaatgcatggcacggtgccagcgccattttatccagttcgcctacgttccacgctgaaacaataatgcgacgggaatccgggtcgtttttcagctggttcagtacagtagtgatctggtcaatatgacgaccatccggcgttggccaggcgcgccactgtttaccatacactggcccgaggtcgccgttttcatcggcccattcgtcccagatggtgacattgttttcgtgtagataagcaatgttagtgtcgccctgcaggaaccacagcagttcgtggatgatggaacgcaggtggcaacgtttagttgtcaccagcgggaatccatcctgcaggttaaaacgcatctgatgaccaaaaatggaaagcgttccggttccggtacggtcgtttttctgtgtgccttcgtcgagcactttttgcatcagttctaaatactgtttcatggttcctcaggaaacgtgttgctgtgggctgcgacgatatgcccagaccatcatgatcacacccgcgacaatcatcgggatggaaagaatttgccccatgctgatgtactgcacccaggcaccagtaaactgcgcgtcgggctggcggaaaaactcaacaatgatgcgaaacgcgccgtaaccaatcaggaacaagcctgagacagctcccattgggcgcggtttacgaatatacaggttgaggataataaacagcaccacaccttccagcagcagctcgtaaagctgtgatgggtggcgcggcagcacaccgtaagtgtcgaaaatggattgccactgcgggttggtttgcagcagcaaaatatcttctgtacgggagccagggaacagcatggcaaacgggaagttcgggtcaacgcggccccacaattcaccgttaataaagttgcccagacgcccggcaccaagaccaaacggaatgagtggagcaataaaatcagagacctggaagaaggaacgtttagtacggcgggcgaagataatcatcaccacgataacgccaatcaggccgccgtggaaggacatgccgccgtcccagacacggaaaagatacagcggatcggccataaactgcgggaaattgtagaacagaacataaccaatacgtccaccgaggaagacgccgaggaagcccgcatagagtaagttttcaacttcatttttggtccagccactgcccggacgattcgcccgtcgtgttgccagccacattgcaaaaatgaaacccaccagatacatcaggccgtaccagtgaagcgccacgggtcctattgagaaaatgaccggatcaaactccggaaaatgcagatagctactggtcatctgtcaccacaagttcttgttatttcgctgaaagagaacagcgattgaaatgcgcgccgcaggtttcaggcgctccaaaggtgcgaataatagcacaaggggacctggctggttgccggataccgttaaaagatatgtatatgatccgcgctataaccccccgcgaatcagcccgcccatgccgcgacgctccataaaggctgcaacctgatggcgaacttcggtcgccagttgcgcttccagactacgctgcgcaagattttctgcttcagcaaaatcaatgcgccgcagcaggtattttacgcgcgctacagaacgtccgttcatagacagatggcgatacccaagcccaatgaggattgccacgcacatgggatcgcccgccatttcaccgcacaaacggagatcgattccatgtatttccgcttcccgggcgatcatcgccagagctcgtaacattgcaggatgaagactgtcataaatgttcgccacccgggtattgttgcgatcaacggccaggatgtattgagtcagatcgttggtgccaacagagatgaaatcgacccgctttgccagatgcggcagcataaataccattgacggcacttccagcatgatgccgatacgtggtttaggaatttcgtaaccgatcatctcctcgacttcacgtccggcacgttcaatcaggcggcgtgcttcgtcaacttcatcgaggcttgtgaccatcggcaacagaatattcaggttgcccgtagcggcattagcacgcagcatcgcccgcacctggatcaagaagatctccggctgatcgagcgtaatgcgaatcccacgccaacccaggcatggattctcttcgctgatcggcatgtaaggcagctgcttatctgctccgacatccagcgtacgcaaggtgacgggtttatcattaaacatttgcagcatcccctgatactgcgccacctgttcttcttccgacggaaaaccactttgcagcatgaatgggatttcagtgcgataaagtcctatgccatcaatacggctgcccagtttttcttcatgttccgggcttaaaccggcattgagcatgactttaatgcgttcgccgctttttaactgggcgggtaaattgacgtcatcttccgccagacggctaagctcgatctcttcactaattagccgctgatattcttgcagcagtaccggctccggatcgaccagcaattcaccgcgataaccatcgacgatcagcgtccgacgatgcagtaccgaaggctgaatatccgcgcccatcacggtaggtatccccagcgcacgtaccatgatcgcagcatgggagttggcagcgccatcgcgcacgacaacaccgactaagcgatcctggggcagctcagcaagcgttgtcgctgacagttcatctgccaccagaatgaaacgttccggccaggcgttcggcccttgattagcgtcatcaagatgaaacagcaatcgctgacccagcgcacgtaaatcgccagcccgctctttgagatagttatcgcttagcgcggcaaactgttcggcaaatttttcaatgaccgtttttaccgcccactctgccaccgagcctttatcaacctcggcaaacaattcgcgacgcagccgggtatccgaaagcaggtgtgagtaaagatcgaaaatagccgccgtttctttttgtgcaccggcagcaaagcgtttgctatagcggcgaaactcgttagccgcctcttccaacgccccggtcagtcgttcgcgttccagagccggatccagcgttgatgcctgatacacctgttccattaaaggtaacgtggcatcctgccagccttcggcaatcgccacaccaggtgctgccggtaatgcacggattcgcgtctggcgatattgcccaaacaaggcagtcaactgcgactgagaaagaataactgccatctgggtggcaagcgtcaccaggaaggattcttcactttcgtcatactggcgcaactctcgttgctgtaccaccagtacaccaagcaactggcgacgttgaataattggtacgcctaaaaacgcgcggaaacgttcttcttttacggaggggatgtatttgaagctggggtgcttttgcgcatctgcaaggtttatcggttccgccagcctgccaaccaggccgacgatcccttcatcaaacgcgagcgttacagtgcgaccgcgtggttttttcagtccccgggtcgccatcaggtagtaacaacgtcgatcatgatcggctaggtagaccgaacagacctcggtatccatcgcaagacagatgtcggtaaccagaatatttaacgcctcattcaggcgtggtgcgctggctaccttttcgactatttcgcgcaggcgagtgagcataattggcgtgacttaacctcttttacgtcgataagcagatgcgttttgtggttttggcgtattttcctgcagtgacatcaccacactcgcgaactctttcattaccctacggtagacatcacgtttaaatgacaccacctgtctgactggataccagtaacttacccatcgccagccgtcaaactctggtgtactgctggtttgcatattgatttctgcatcgccgctcaccagctgcaagagaaaccatttttgtttttggccgatacaaaccggcttcgtgtcccaacgcaccaaacgtttcggtaatttgtagcgcaaccagttacgcgttgaagcaaggattcgaacgtctttgcggcttaatcctacttcttcaaacaattcacggtacatcgcctgctctgcggattctccggggttgattccgccttgcggaaattgccaggagtgctgaccaaatcgccgggcccacattacctgcccctggcgattacaaatcacgatacctacgtttgggcggtagccatcgtcatcaatcaccggactacctcaaaataaagctttatatacgaatgattgtttcatactccagtaagacggtaaaccactctctgcagggcattacacactaataacaattgaataactcacagttatgtgcagagttataaacagaggaaggggtggatagccgtttttattcaccttttctgtggatagagttgtgaagaactacggaattactacgggaaaacccggagcattctgaataagacagatatagagattttaaaatattcattatcagtcaatgcattacatgtgatttgagtaataaaaaagagtaattcgtgacccaggtcacacctctcatttacgtgttggcgaaagatcaaccaatgccgtatttatccacagaatgtgccactaagttaagcactgaaccactaaaaactggagtttcgtcgcacgtcaaggctgtaaatggaaacagtagtggaggtttttcacagttatcccagctttctgtggataacatggtgtaagatcctgtttattttcagtgaccagatttggaaaacccgttgcagtgttgcgcaactcgtttaccggcaacctaaaaagcaatataaatcagagaattgaacaacgcatgtggaaaaagttacactgcgaatattcagcacataattgctgtttgttttttaaccaaggtatcatgacatgtcccaacctcgcccactgctctctcctcccgaaactgaagaacaattgttagcgcaagcacaacaactttctggttatacattgggagaactggcggcacttgccgggctggttacgccggagaatttaaaacgcgataagggctggattggcgtgttactggagatctggctaggtgccagcgcagggagtaaacctgagcaagattttgctgctctgggcgtggaacttaaaactatccctgtggatagtcttggtcgtccactggaaacaacattcgtttgtgttgccccgttaacgggcaatagcggggtgacctgggaaaccagccacgtgcgccacaagctcaaacgcgtgctgtggataccggttgaaggcgagcgcagcatcccgctggcaaagcgtcgcgtaggatcaccgttgctgtggagcccgaatgaagaggaagaccggcagctacgcgaagactgggaagaattaatggatatgattgttctcggtcagattgagcggatcaccgctcgtcacggggaatatttacagatacgaccgaaagcagcgaatgcgaaagcgctgaccgaagctattggtgcccggggcgaacggattctgacgctgccgcgcggattttatttgaagaagaatttcaccagtgcgctactggcccgtcattttctgatccagtagccatcgctttgacctgctgctttccgggcatataattaccgcttcatttttttggcagggctttttagatgttatttgcatggataaccgatcctaacgcctggcttgcgctcggtacactgacgctgctggagatcgttcttgggatcgacaatattattttcctttctctggtggtggcaaagcttcccacagcacaacgtgctcatgcgcgccgtctggggttggcgggagccatggttatgcgtctggcgctgctggcatccatcgcctgggttacgcgcctgacgaatccgctttttacaatattcagtcaggaaatttccgcccgtgatttgatcctgcttctgggtggcttgttccttatctggaaagccagcaaggaaatccacgaatccatcgaaggtgaagaagaagggctgaaaacacgcgtttcatcattcctcggcgctatcgtgcagattatgctgctggatattatcttcagcctcgactcggtgattaccgctgtgggtctgtcagatcacctgtttattatgatggctgccgtggtgattgccgtaggcgtgatgatgttcgccgcgcgctcgattggtgattttgtcgagcgccatccttcggtaaaaatgctggcgctatctttcctgattctggtgggctttaccctgattctggaaagtttcgacatccacgtaccgaaaggttacatctacttcgcgatgttcttctctattgcggttgaaagcctcaacctgattcgcaacaaaaagaatccgctctgatactccgtacgctctcctgcgggagggcgtactcactcctgttaccctcacagtttaagattttcctgctttcaagatatataacgtcggtttataaacagactattatcacaggtgggccaaatgaggataaccggatgaaaaaatgggcagtaataatttctgcagtcggactggcgtttgctgtttccgggtgttccagtgattacgtcatggcgaccaaagatggccgtatgattttgaccgatggaaaacctgaaattgatgatgataccgggctggtgagttatcacgatcagcaaggtaacgcgatgcaaattaaccgtgatgatgtttcgcaaattattgaacgttaacaaataaggtcagcatccggctggccttaagatttttctctttcccttttcccttccctctgccatttttatattccttatgtcgtgattataaaaaggaaacggctatgcaatatcaccgtataccccacagttcgctggaagtcagcacgctggggcttggcacgatgacgtttggtgaacagaacagcgaagccgacgcccacgcacaactcgactatgccgtcgctcagggcattaaccttatcgacgttgccgaaatgtacccagtacctccgcgccccgaaactcaagggctaaccgaaacctacgtcggcaactggctggcgaaacatggcagccgcgaaaagttaattatcgcctccaaagtgagcggaccgtcgcgcaataatgacaaaggcatccgcccggatcaggcgctggatcggaagaatatccgcgaagcgctgcatgacagcctcaagcgtctgcagactgattacctcgatctttatcaggtgcactggccgcagcgcccaaccaactgcttcggcaaactcggttatagctggacagattctgcgcctgcggtttcgctgctggatacactggacgcactggcagagtaccaacgcgcgggaaaaattcgttatatcggcgtgtcgaacgaaactgcatttgtcgtaatgcgctacctgcatctggcggacaaacacgatctgccgcgtattgtcaccattcagaacccctacagtctgttaaaccgcagttttgaagtaggtctggcagaagtcagccagtatgaaggggtcgaactgctggcctattcgtgcctgggtttcggcacgctgaccgggaaatatctcaacggtgcaaaacccgctggcgcacgtaatacgctctttagtcggttcacccgctatagcggtgagcaaacgcaaaaagccgtcgcagcgtatgttgatatcgccagacgtcatggcctggatcctgcacagatggcgctcgcttttgtacgccgtcaaccgtttgttgccagcactctgctgggcgcaaccacgatggagcagctgaaaactaacgtcgaaagtttgcatctggagttaagcgaagacgtgttggcagaaattgaagcggtgcatcaggtttacacttatccggcaccataagattaacgccggttaaaaccggcgttaaatattaatgacggcgctgccagatccacagcgccgttattgccagcgcaaacagcgcaccgaagccaatgccaatgggcacgaccgggatgcctaccattaccgccagcgagtaaatgcccagcatcaacaacatggcgctgttttcgccaaggttttgtactgcaatcgcattccccgccccgacgctttttttaccccgctcctgtagcaacgcattgagcggaacgacaaaaaagccccccagcacgccaatcagcatcaacaaagcataggctggcagcagctcgtgttgcagggagaaaatcagtaccaccacgccaatcaaaatcccggctggcatacagcgtgacacggtttccagcgtaactaacttcgctgccgcacctgcaccaactacgataccaatcgctaccatcgcgttgagataggtcggcgtagcgttatcggtaatacccagcgccaccggtacccacagcaccaacaggaaacgcagcgtgacacccgctccccagaataaactggtgcccaccagcgaaaaacgcgtttcaccattgcgccatagcgaggtgcaggcattcaggaaactgcgggtcatgctgatgagattccaggactgccccggacgcgccgccgccagtttgggaatgtagatattggcaacgaccgcgccaccgtaggccagtgcgcatgcgaccagggcaaccagaatatgccagtcagccagaacaccaccagctacggaaccgagcaaaatcgccgctatggtagacgcttccattaaaccgttagcttttactaacttactacccgtggttaattcgccgagaataccgtatttcgccggtgaataggctgcagcacccacacccaccaacgtatagccgagaaacggattgataccaaagcagatactggctgcgcccagtagcttcaggccgttggcaaacatcatcacccggcctttggcgaagctatccgccacctgcccgacaaacggcgcaaaaagaatgtaagcacctacaaacaccatttgcaggatgggctggctccactccggatagaactgcgctttcagtaacgccagagtggcaaacagtagcgcattatcgccaaacgcagagagaaactgcgccacgataaccgctttcatccccttcgaccacaacgaagtgttagtgtgcactgactcactcatcgtgttgttccgcttcgtctacccagcttttcaaagtgacaaagtcaggtttgccgctgccaagtaatggcatctgtttcagatagcgaatatcgcgcggtacagcaagctccggcacgccgtgctcgcgggcatactgttgtaacttatcgcgcgtcagttcgttatctgtggtgaaaagcaccagtgcctcgcctttgctggcatcgctcttaatcgcagtggcatggactttatctggcgaaacaccaagtgccagttgttccaccatttccagcgataccatttcgcctgcaattttggcaaagcgttttgcgcggccctgaatctgcacaaagccctgctcgtcaaaacgcacgatatcgccagtgtcataccagccgcgctccatttcgccgcgaacattctcggcggtgggcacttccagtacaccaagcttctccacccgcagatacccgttcattatgttcggccctttcagttgcaggcgtccgccctcttcaataccaggaaccgacaacaggcgcgcatccattcctggtagaatacgccctaccgtaccgggtttcgccgccatcggtacgttgatggaaacgacaggcgcgcactcggtcacaccgtagccttcaaggatgcgcaggccaaatttatcctgccaaagctgtttggtactttcttgtagtttttctgcgcctgccaccacatagcgtagacgatagaagtcatacgggttggcgaaacgcgcgtagtgaccgaggaaagtggaggtaccgaacaacacggtgcaactgcggtcatacaccaactccggcacaatacggtaatgcagcgggcttggataaaggaacacttctgcacctgtgagcagtggcgtaaacaggcctaccgtcagcccaaaggagtgaaacagcggtaacgccgacataaagcgatcgttggtggtgaagtcggcaatcgttttaatctgctcgacattcgccagaatgcttttatggctatggacgacgcctttcggatggccttcagaaccggaggtaaaaaggatcagcgcctcttcttccggctgctgtttaacctgtgccagacgcggcatcagcaaatgagcgaagatccatactttgtcggcagtggtgacatctgcttttaaatcttccagatagacccagcgcacctgagtaagttgctccggcagatgccagagtttgcctttatcgagaaactgacgggaagtgaaaatggttttgatttcagccgccgtaatagcactggtcaacccttttaccccggcggtgtagttcatcattgcgggaatgcggcgacgggcgatggccccaaaaatcactgcagcactgatgcctgcattgggcagcattaagccgatgcgttcgccttcaacactgtatttttcaaggatgcgtccaacaaacagcgttttcgtaagcaatttgcgataggagtccggggtaaagttaacgtcttcgacacatttcttcccggctccgaagcggtacattgcgctcagtaaagattcgtacagcgtttcacgcgggcgcaccgccatacgcgcttccatcattatttgatgcagcatttcgccagcgattttgcgacggtcacgggcacgcggcgcatccggcatctccacctgcgttggtggcaaaatatgcagagtaatttgcgggaacaagcgacgtttaaccagacctttcaggcggctgaagtgcgtaagttccgccccttcaatacgcacaggaataaccgttgcaccagacttcgccgcgacaaatcccgcgccatcgtagattttcatcagcgagccagtggtggtgatgcgtccttcagggaaaatcaccactggtcgtccctgttccaccagacgtaccagatgtttaatcgccataggttgcgtcgggtcgagaggaacaaagtcgataaatgatttcagccaacgcatataccactgttggcttattgaggtgtaaacggcaaataccggacgtacgggtaaaaacaatgccagcagtatgccatcaataaaagagacgtgattaggcgtaattagaacgcgctcgcccttcagtgccttggtgtcacccgtaacgcgaacgcgatacaaaacacggcacaaatttcgaaaaaagctaaaaagcattccaactccctttgctctgattcagtaaaagcgaatggagggagattacacgagataaagaacgcgagcgacagtaaattaggtgcgaaaaaaaacctgcgcatccgcgcaggttggtgcaagagactgggtacgaagagcgtaccgaataatctcaccaatcaatacctctgggatcttgattgtggtctgcacaacgactcttcgccagcgagaaaacgcaaaggaatgaagggaaatgcaacgaggtgtgtaaattgtcggttactgttacagattgatgaccggcaaaaaaaaacctgcgcatctgcgcaggctggtgtaattcatgtgctcaacccgaagttgacttcacctatcaatacctctgggatcaccactttagcaacctgaagccaaacgccaccagcggtcaatcgcaacagcgtttcgcaaagtgtaaccaaaggtttgcaatctctttttttgtcttacttatttgcgtttggctcacattcccacaatgaaaacacgccgccccttgaaccaacgggcattttccgtaacactgaaagaatgtaagcgtttacccactaaggtattttcatggcgaccataaaggatgtagcccgactggcaggcgtttcagtcgccaccgtttcccgcgtcattaataattcacccaaagccagcgaagcttcccggcttgctgtgcatagtgcaatggagtctcttagctatcacccgaacgccaacgcccgtgcgctggcgcagcagaccactgaaacgatcggtctggtcgttggtgatgtttccgatccgtttttcggcgcaatggtgaaagcggtcgaacaggtggcttatcacactggtaattttttattgattggcaacggttaccacaacgaacaaaaagagcgtcaggccattgagcaactgatccgccatcgctgtgctgcgctggttgtccatgccaaaatgatcccggatgccgatttagcctcattaatgaaacaaatgcccggtatggtgctgatcaaccgtatcctgcctggctttgaaaaccgttgtattgctctggacgatcgttacggtgcctggctggcaacgcgtcatttaattcagcaaggtcatacccgcattggttatctgtgctctaaccactctatttctgacgccgaagatcgtctgcaagggtattacgatgcccttgctgaaagtggtattccggccaatgaccggctggtgacatttggcgaaccagacgaaagcggcggcgaacaggcaatgaccgagcttttgggacgaggcagaaatttcactgcggtagcctgttataacgattcaatggcggcgggcgcgatgggcgtgctcaatgataatggtattgatgtaccgggtgagatttcgttaattggctttgatgatgtgctggtgtcacgctatgtgcgtccgcgcctgaccaccgtgcgttacccaatcgtgacgatggcgacgcaggctgccgaactggctttggcgctggcggataatcgccctctcccggaaatcactaatgtctttagtccgacgctggtacgtcgccattcagtgtcaactccgtcgctggaggcaagtcatcatgcaaccagcgactaaccgcagttaaagcaattccagcgccagtaattcttcaatggtctggcgacggcgaatcaaccgcgcctgaccattatcaaacagaacttctggtaacagcggacggctgttgtagttggatgacattgatgcgccatatgcccccgtatcatgcagtaccagataatcacccgccttcacttccggcaaggcgcgggtttcgacatttcccccttcctgctgggtaaagacatcgcccgattcacataacggcccggcgacgacggtttccaccgttggtgcgtgttccagagaacgaccatcagctgccagggcactgatatggtggtaactaccgtacattgccgggcgcatcagatcgttgaacccggcatcaaccagcacaaagtggcggctacccatttgtttgacgctccgcacttgagtaattaatacgccagcctgcgctaccagaaagcgacccggttcaatttccagtttcacaggatggcccaaatggcgggcgatttgctcacgcgcggcattccacagaccataataatgttcggtatcaaccgcctcttccccctgttgataaggaatagaaagcccaccgcccgcagaaatagcctgtaaatcctgaccgaattcgaggacctgacgcaccatagcaccacatacctgttccagatgggcataatcgacgccagaaccaatgtgcatgtgaatgccgaccagctgtagatgatgacgttgtatcacgtccagtgcggcgggcagatcggtgtaccagataccgtgcttgctgttttcgccaccggtattggttttttggctatgcccgtgaccaaaccccggattaacacgcagccatacccgatgccctggcgaaacctgacccagttggtcgagcatatcaacagaacccgcattcaccggaatttgcaattcactgacgcgttcaagcgtcgcctgatcgataacatctgccgtaaaaacaatatcatcggggtgcgtttgcggattgtaacccgccgccagtgcacgctctatttcgcctaacgagacggaatccacttttacgccctgctcacgcattaagcgcaaaatatgaatattggaacaggctttctgtgcaaagcgcaccacatcaaactgtttcagcgctgcaatctgccgacgaataatttgcgcatcgtagacccacaccgggcagccaaattctgcgggcaaacgcagcagattttcggcggtgagatcggtatcagtgctgaacagtgaatgtggcataacaaactccagataagtgcttttttatgattacgccacatcataaaaagaataaaaaatatcgatttatgtcgagtctatgcaaaaatgatatggattaccggattgcgagagagcgctaatggccgccgttaacttacgtcatattgaaatttttcatgcggtaatgaccgccggaagcctgactgaggcggcacacctgctacacacctcacagccaaccgtcagccgcgaactggcgcgctttgagaaggtgatcgggctgaaattgtttgagcgcatacgtggacgattacatcctaccgtgcaaggactgcgtctgtttgaagaagtgcaacgatcctggtacggactggatcgcattgtcagtgccgcagaaagtctgcgcgagtttcgccagggagaactgtctattgcctgcctgccggtcttttcgcaatcttttttaccgcagctcctgcaaccctttctggcacgttatcccgatgtcagcttaaacatcgtgccccaggaatcaccgctacttgaagagtggctctcggcccagcgtcatgatttaggactcactgaaacgctccatacgcctgcgggaacagaacgtaccgaattactctctttagatgaagtgtgtgtgttacctccgggccatccgctggcggtaaaaaaggtattaacgccggatgattttcacggtgagaactacatcagcctttcccgtactgacagctatcgccagttgctggatcaattgtttactgagaatcaggttaaacgacgcatgatcgtagaaacccacagcgccgcgtcagtctgcgcaatggtacgggcgggggtaggcgtttcggtggttaacccgctcaccgcactggattatgcggcaagcggtttagtggtgcggcggttcagcattgcggttccgttcactgtcagcctgatccgccccctgcaccgcccgtcatcagcgctggtgcaggcgtttagtgagcatttacaagcgggattaccgaaactggtcacttctcttgacgctattttgtcgtcagctacgacagcataaaagcgacagcatcctcggcatggatcgccgcggtatcaaacacaggcagaacactgcgctcttctggcaccagtaaaccaatttctgtgcagccaaaaatgacgccctgtgcgccctgttctgcaaggcgagcaatcacttgcgcataataagcgcgtgacgcttcagtaaattgccccagacacagttcttcaaaaataatctgattaatttttgcccgttcatccgcttcaggaataagacagttgatggaaaattgttccgtcagccgcccgcgataaaaatcctgttccatggtgtaacgtgtacccagcagcgccacacgagtcattcctgccccggtaattgcacgtccagtggcatccgctatgtgtaagaaaggcagagagcaacgagactcaatggcatccgccactttatgcatcgtattggtgcataacacaataccttctgcgcccgcccgctgtaagccaagcgccgcctcagccagaatatccccggttttgtcccactcaccgcgacgctggcactcttctatttcatgaaaatcgacgctatgtagcagcacttgcgcagagtgaagcccaccaagccgctgtttaatgccttcattgatcagacgatagtaaggaatagtggattcccagctcattcctcccagcaaaccaattgttttcattcctctctcctgatgtgtgttaccgcaacaaggctgaataaggaacgagacaaacgcctcaacggccaggtgcctaatctctattaacgaaaaaagggccggatgtacagcacatccggcccgtgaaatcagacgccgatatttctcaacttttcgcctgccatcagtttgcgctcgatatgttccagcgtgacatttttggtttccggaatgagccagaaagtgatgcccacaaacgcaatgttcagcgcagtgtagagccagaacgtaccggcagcgccaatgctatcaagcagtgtcaggaaggtcgcgccgataatcatattcgacacccagtttgtcgtcgttgagcaggtgatgccaaaatcgcggcatttcagcggctgaatttcagagcacaagatccacaccactggcgcggcgctcatcgcataaccggcaatacacatcatcgtcatgccaacagagagccaggacaagccactggaagccgtaccattatcaaactgcatcaggcagtaacccagcaccagagtgcctaacgccatcacgctgaaaccaattttcagagccggcttacgccctgctttatctaccgtaaagaccgcaatgaaggtagcgaacataaaggtcagccccacgaccagagtcgcaatcatctgttgttctgtggtcgtaaagcccgccattttgaagatacgtggcgcgtagtacatgatgatgttcataccggtaaactgctgcatcgcctgcaacaacataccgagaaatacagcacgacggacgttacggttgatcttaaacagtgcccaaccgccctgttttaacttcaggctttcacgaatttcgttgagttcttctcgcgctttttccgacgtatcgcgcagcatacgcaatacttcttccgcctcaatatgacgccccttttccgccagccagcgcgggctatttggcaggaagaccaccagaataatcagcagaactgctggtaaagcaagaacccccaacattgcgcgccagttaccgctataactgaacgctgtatcggataaaaacgccagcacgatgcctagagtgaccatcaactggtacatgctgatcatcttaccgcgaacgttttcacttgccatttcagaaagatatagaggagcggtgtaagacgcgatcccgacagcaatgcccaacaccacacgagcggcgattaacatctctacgctggtcgcaaaagcggaccctatcgaaccgagtacaaacaggatggcccccgccatcagactgtatttacgccccaggcggaacgacagccaaccattaaacagcgcaccaattgccgcgccgagcatcatgctactgaccacccattcctgcaaacgactggtcagcacaaagtgatcggtaatgaacggcaacgctccggcgattacgccgatatcaagaccaaataacaatcctgcgaccgcagcagctaccgaaacaaacatattcatacgccgcgtatcccgcagaggacgtggcgttaaagcagattccgtattgatagtaaccattttttcctgccagcagagagtaagacatagtgaaaaaatacgtgaacaattcacacaggtgtcaggtcggaaatagcataaatatggattaaattgctacggaatgtcgttatgtgatggatattccaattttcaaattaagttgaattattgagattattattaaccacctaattttaaagcagataaaattcataaagttcatcaattgataattgatatggattatttcataaccatgatatggattatttcataaccatgatatggattatgatgatctacaggtataaaaaaccctgccatgcgacagggtcataaaagtaagaggaatgaattaacgcgccagccaaccgccatccacggcaatggtataaccattcacataatctgaagcgctggaggcaaggaacaccaccggccccatcaggtcactcggcagtccccaacggccagctggaatgcggtcgagaatttccgcgctacgttgttcatctgcccgcagttgttgagtattgttggtcgccatgtaacccggagctatcgcattaacattaatgttgtgtttagcccattcgttcgccatcaatcgcgtcacgcccatcacaccgctttttgatgcggtataagaaggcacacggatcccgccctggaaggagagcattgacgcgatattgataatcttgccgccattgccttgcgcgataaagtgtttcgccgctgcctgagacatgaagaatacgctcttgatattcaggttcatgacatcgtcccagtctttttcgctgaattcgagagcgtcttcgcggcgaatcaatccggcgttattcaccaggatatcaatatgaccaaactcagctaccgcgcgatccagcagtgctggaatgccatcaatctttcgcagatcggcggtcaggcttaaaaaacgacgccccagcgccgtgacctgcttgatggtttcagtcggttcaacgatgttaatgccaacaatgtcacagcccgcttgcgccagccccaacgccatcccctggcccagcccagtatcacaaccagtgacgaccgcaactttaccttcgagagaaaatgcacttaaaatcataacaataccttattcgtttatgcccacaactagcgcaaatctttaacggccacatggtccatatcatcaaaaacctggttttcaccgaccatgccccagataaaggtataagctttggttccgacgccggaatggatcgaccagctcggggagatcaccgcctgctcgttatgcatcacaatgtgacgcgtttcttgcggttgccccatcatgtggaaaacgcaggcgtcatcatccatattgaaatagaaataaacttccatccggcgctcgtgggtgtgacacggcatggtgttccacaagttacctggagccagctccgtcagccccatactcaattggcaggtttccagcacatccgggacaaaatatttgttaatcgtgcgacggttactggtgaggttatcgcctaacgtgactggagatacttcgtccggtgtgacttttttggtgggatacgtcgtatgcgcgggtgcgcaattgtaataaaacttcgccggagtggcggtatcaatactggcaaagacaacttcttttgcacctttaccaacatacagggcgtcgcggtgaccgatttcatagcattgaccatcgacagtaatcgtaccggcaccgccaatattgataacacctaactcgcgacgttcaaggaaatagcttacgccgagttgtttaccaacttccccgccaacggaaaccgttttagttaccggcataatgccgccaacaataatacggtcaatgtggctgtaaaccatggtgtactcatcggcgacaaataccttttcaaccaaaaattcattgcgcagcccctgggtatccagcgtttttgcgtgcgcactgtggatgctctgtcttacgtccacatcaacctccgataatcagtgaagcgtgaaaatagaaaacaacaatgaaacactgtttcgttttctctatgaggggatgatatgcccatgggatatggttttcaattaaaaataaaacaatgtttcattttcaagttaaggattaaaaaaagtgcagtgtcgatcacgaatatgtcatgagaatggaaaaatcagggagccctgaaaaggtatgtcgactcaccagccatcattattcaacagattaatgacggcagatatttatcggtaaggaggaaatgcagagctactcgtcacgttcaatggtcaatgccacaccctggcccccgccgatacaaagcgttgccagtcctttgcgggcattacgtttcaccatttcatgaacaagagaaaccaggattcggcaaccggaagcgcctatcggatgaccgagtgcgatcgcaccaccattgacattgacccgacgctcatcccattcgagcatcttgccaaccgaaagcgcctgtgcagcaaacgcttcattagcctcgataagatcgacatcagccaactgccagccaacacgctccaggcaacggcgggtcgcatacaccggcgcaattcccatcaatgccggatccacaccaacgctggcaaatgcgcggatgcgggccagcacgggtaaattcaacgctcgtgctttggcttcgctcatcatcattactgcagctgccccatcgtttatggatgatgcattacccgctgtcacagaaccgagactatcaaatgaaggatttaaacgggctaagccttctgcgctggtgtcagtgcgtggctgttcatcggtatcaacaaccaacgtctgtccgttactttgggttattaccgggacgatctcatctttaaatcgtccggcgtcaatcgccgctcgcgctttttgttgcgagctaagtgcgtaagcatcctgcaactgacggctgatgccatattcgcgagccagattttcggcggtgacaccaatatgataatcattgaaggcatcccacaacccatcatgcacaagactatcaaccaactggctattgccaagctgtgcgccggtgcggctatcagtcagaacatgtggtgcgcggctcatgttttcctggccaccggcgatgacaatatcagcctcgccacactgtatcgcctgagtagccagatgcagtgctttaagcccggaaccacaaacgtcattaatagtgattgcagaaacgctattaggaagaccacctttaatagccgattgtcttgccggattctgccctgcccctgcagtcaacacctgaccaagaatcacttcatccaccgcatatgcaggaacgccggtacgttctattaacgctttgacgaccaggctgccaagttccacggcggaatgacccgctaacgcaccacgaaagcagccgataggtgtccgtaacgccccgacaatcacaacgtctttcatcacaacctcgcaccaattaacagtgcaatagtaaatgattgttaattacagttatcttaattgtttaaaaaaagtggctattatcacaaaggaaatacgcctgagtagtagtcagagacataactggcacgtaaggtttgcaaccactaactcaccaatagagaggtagatagggcgttaatctcccatacttaacctggtttatggtaaattgccctccattttgtttaatttgtagatgatacgttcagataatgtctaatatttggtcaaaagaagaaactctgtggagtttcgcgctctacggcacagccgttggtgcaggcacgctcttccttcctattcagttaggttcggcgggggctgtggtcctgtttattactgctctggtcgcctggcctttaacatattggccacataaagccttatgccagttcatcctctcatcgaaaacatcagcaggtgaagggataacgggcgcggtaacacactactatggcaagaagattggtaatctgattaccacgctgtacttcatcgccttttttgtcgtcgtgttgatatatgcagtggcaattaccaactcacttacggaacagctggcaaagcatatggttattgatcttcgcatccgtatgttggtgagtctgggggttgtattaatcctgaatctcatttttctgatgggacgccatgcaaccattcgggtaatgggatttttggtattcccattgattgcctatttcttatttctttctatttacctggtcggtagttggcaacctgatctattaacaacccaggtagagttcaatcagaatacccttcaccagatatggatatcgattcctgtgatggttttcgcttttagccatacgcccattatttctacgtttgccatagacagacgtgaaaaatatggcgaacatgctatggataaatgcaaaaaaattatgaaagtcgcttatctcatcatctgcataagtgtattgttctttgtctttagctgcctgctttctattccaccttcgtatattgaagcggctaaagaagaaggggttaccattttatcggcgctttctatgctgccgaacgccccagcatggttatcaatttccgggattattgtcgcagtagttgcgatgtcgaaatcattcctgggtacgtactttggcgttattgaaggtgccacagaggtcgtcaaaacaacattacagcaggttggtgtaaagaaaagtcgtgcatttaaccgcgcactatcaattatgttggtatcgctgattaccttcattgtttgttgcattaacccgaacgcgatttcgatgatttacgcgatcagcggcccgctcattgccatgatacttttcatcatgcctacgctgtcaacgtatctcatcccggcgcttaaaccctgacgttccatcggaaatctgattacgctgatcgtgggtatcctgtgcgtatcggtaatgttctttagctaatatccgttgtggatggttcaaaattgcttcaattttgaaccatcccagttttcataatgttcatttgttattattccgccctatcacttctctcgtaatattatataattatcagctagttaaacacacaaagagttctgaacatcttaaataagactatttaagatacatgacgattgcattgcgtaaacgctttttatttacaaaaaatggggaagtattacggcgattgcgaaaagtctgaagcgcttgagaggcaaagggaacagaacaacaagccatgacaccagtaataaagccatttctacatattctaaaataaatcctatacacatttctatacacatttagcaggcgcttgatgacttactcaggcaaatatttaccggattttttccggttatcctctatgaagctggtggggtgtggtcattttagccataccctcgatcaccataatgatgatccagatgtgcacctttcccccccccaacggggtaaaagctccaactgtaacgatgttcgttatggttgtctggatggtctgcgtggtgattatcaccattcagatcattcacacgctttatatatataggaaaaatgtgtcgcctcagttgcctcaaacgccttaacgtattgatttaattaataatcacaaaaaaaaattgaggcgacatcatgtcgatttgaggcaacaatagggggtatttgaggcaacatcacgttgaatgcgttcagcgaaaaccgccgagaagcctctcccgatagcgcggagagcagtcatggacacctttccgtgatgcaaatcccccattttaggggatgttctctcgttttgatggatatccctcgctttaggggattttccctccatttgagggctatatctcaccgcctgtacccgttccgtactctcgtggcataatcatcagtgcttactttttccgtgactgaaaagccatacttaccaaccgtagctccttgtgactgcggtttttttctgcgtgttatgccgtcactgattcacgctcaacataccgatccatctcaaggctcacatccagcatcatcaacatgccttcaacaacgccttcagctttctgtagccgctttccgatgtgtccatcagagcacccatgcttccgtgccagcgccataaacgttttccccagcacgtagtaatccaccagcaagtcatgcagatcgcggttgttccggtaaaggcgagctatacacccgcatataatcatcgcatcatcgtcgcagcactgcggacgtgacgttacctttggcggaataagccccttaaatccagaggcaatgggcgaccaggtcacatcctcatgattatttgccgcccatgctccccagcgttcaagcaccagttgaatatcgcgcacgtattacgcctcctgtgatgtgtttaaggttgtgctatgacttatgccgattgctgcaaggtccaccagccaaatacatcactcgattgcgagggatgtaaaaatcatggctggttggtccggtctggatggtttacataccccgatatcggggatgtacaaatcagggttttacggctggtggatttgctcaactcaaaattgaggtttgctgaaatatcagcgggtaaggccagaatgtaaatttacattctgtcagccaacgcaatttggcgtttgctatttccaccaggtcagttattaaactgcgaaaatctcgtagttcatacctcagatgtgagacatgtagccagcgcaattttgcgctttgctttaaggtcagtaagttacagcgccagagtgcaaatttgcactctggaacaatatcaaccagttactaccgtaacggttgaacggggttactatctgtcactctgttgcgagtcactattagtgactcacaaataatgctgacactaccgccgcaaccgctccggcgtcttccactggtacggggccgcgctctggcgttgctcccgtttttgtcttgctgccagcatatcaagcacccttgttcggataaccagacagtcctgcccgttcagttcgataccatcacggcgcatcacctcagcaacaacacgcgcataatttccggcggtggtgttaataaccaactgcgtggcctcctgtttgcgctggcgctctatctgctcggcaatcataagggttaactcgcgttcctcctgctcttcgataatcccgtgaattatctccgttggtgatcgatcgttcatcggtccccccctgtgagttgcggttatgccaggaatgttaacccgtactcccgtttctgccctgtaaaaaagtccatttttgcgcactttttcgatcatcacgtatcggtttcgttttgcgcggctgttgcgtttcgttttgcgcactttttttgaattttttgcgcactttttccggtggtctttccctatgcaagccgtgtcattactggctttgttctggtgatcagcatgatcgattttatgatcgaatttgcgcagtttttatcgtcaatttgcgcagttttctgcgcacttttcggggaattgttgccctacggaatgtgtgcatcaggagcggtatgtaactgactttgtaactgacttactgtcagccgcaatcactactggcaattgcagatttcttacgcgattttaaaatcaggccttccgttgtgacatttctttgatgtgcatgaggtatattgctcgcaggttatctttcgcccatgtcgtcaatagttttacggccttaattagatcgttaaacgtatcgacatcgctcagtccggtttggttatttgggatttgtgttattgatcagatcgcataatctggattgagttccctcaaatacgaagtgatctactattccgaacagctatttaggaagtggtttagggataaatatcaaatactggctggatatattatccagccagataattaaattaattgtataacttttttaattagtgatctcaatcattttcacttttctattttcagtcctagaaactgtagctgcatcagctgtggctattgcagacatagcagcctcaccattgagcagatcaatataatcatcatcaggtttttcaccactcaaaaccttatgaagaaataatgtttctttttttattaaactggcaagccataatggtgtttttttacctggacgaccatatgcgatagcaccatccatttcagacgtcaaatttcctttcttacggtcattatcttcctcttgtgtttcatggaccaaaaaattctctgtcttacctcctactctgagagttcccccagtttcctgcatatcaatttttatagaacctttagttccattgataattacataatgttctggccagttaaaagcacttccccattctaatgtcgcaatttttcctgacgcaaactctaacgtcataaatagcatatcatcttcattaccaaatccaggaccagagtgagctaaatttcctccaatcatagttacagtatcaggtttttcacccagcaaatgttgaacacaatctaattcatgtatatgatggtaaagatgaccaccagattgctctttaatctttttccaggagagatgttcctgtttattttcccaaccatttctctttgtatggcaagataaaacattcccaatcactccatcttttattaacttcctcgcatattgaacaccattaaaaaagttcattatatgaccagccataaaagtcacacctgcgtttttacaagcatggaccatatctttacaatctttataatttaaagaaattggtttctcacagaaaacatgctttttatattttgcggctttaatcactggctctttatgtaaatagtttggagtagcaacaattacgcaatctactagttcgcttgaaaccaaatcatccagagttgacatatttatacaatttaattctttagcaatagtctctccattttcaggatcataaacacatgttattttggcattttcattcatattcataaaacgagctaattctgcgccaaaatatccaacaccaacaacgccataattaatcataaagcctcctaattattttactgcggataatttatagattttacctggaatatcaaaaccaactaataaaattaataatacagagaatgcaactgtaacaataaataatgaaacacctaagccataatatcctgaaatgtatgtggctaatacaggtgcagccattcctccagttgctcctaagttataaataagacctgttcctaatcctcttaattttgttggaaagtaatcatatataaattttggaaccaacccagcaatacctaaatttgtaaacattaatccaaagagacataatcctataagagaagagtttttcacagaaataaagaagagtgggcaaaggaaaataaatgaactgattagaccgacgacaaaggctatttttacaccaatcttatcaccaacaaagccaaaaaagattgtacctgtcagtgttcctaaacctgcaattgtcatcaatgttgaaataactgctgtattaactccattttcggccaggtaggaaggaagtagtccgtttatcggccagtttaccccaaatagagaaaaacagactaagaaaacaatcatagagattgagagatgtggtttcctgaatacagataaaaatgtcgatttatccttggatttatcttcaatccactcctgactttctggggcactttttctgatccaaagaacaagtaaaactggtaacaggcctataaaaaatgagcttcgccatccatatacttcggcaaactgaggaattatttgtgcagcgataatattcccaacagaaaaaccactgactaaaaaagcactggctttagattgaagatttttaggccaactttctactgcataggttgaagcgcatgcatattcaccagacatacccagcccaacaataaaacggcacgctgcgagcatatataagtttgtagcaataccgctaagggctgttccaactgaataaatgacaattgcccacatcatcattggtttacgaccatatttatctgccatggccccaaataaaccaccgccaataggcctagctataaaggcgactgtccctattaaagttgcctgaatatctgtaataccaagatctgcttttataatatgaagaatataaaatatcatcataaaatcaaagccgtcaaatacatatccaagccatgcagaaaaaagagctttccgttgtgatggattaacctgtttgtaccatactgttgtcataattgtgtccttcgtagtaattaaacatcaagaaaccttaacaacatccaataaagattatattgtattcagatatgcagtagtattatttatttttatcaatgtacaattcctgtaatctttcctgctatttcctttcaaaatatttcacaataaagtgatagaactaatacccaacatcagttaaaaatattcgcaaagtactccatcactatctacaacgcaactccatttcaatatattctctgttaatctcatttttgtattctgttcagattgaataaaactccccatgatttcccatgttcaaatcaggaaatactgatgatctgatttctttagatcaaatttctgagattactttatatttatctatcaagctgtatacctttatacctgttataccagagcaaaaaacaaatgagctacaacataaaacctgttttgcaataaagctcacaaattaagcatatttccatatctgatagtcgttacaaacaagtcttttccagccgttacttccagcattaccgtatggctgacatttacgaggcggatttgagttcactgtcagttacgggctgtgtatttgcgcgcgcccactgtctggatcgggggacacgtttatccggcgttgctcccatgcttcggtcaccctccacatgtacgccatcgctacgcagtcaaactaaccaattactgcggcaggactctcacctgcaagacactgagcagctttcgaaccgctcagaacgggatatcgtcagggaacaggtcatcgtgattattctgcggtggatgtccccgtgatgaggtctgtgcccctgtgttttgtggctggcctgtgtgttttctctgacctccaccagggcgaacagtacgggcactgattacgctgtcggcgataacctgccacccctgccgcgtctccccgttctgtccggtccactggcttatctgcatgttacccgccacgctgataaggtcgcctttctggtgcttcgccagatggtcggcctgtttaccaaaggctgttacggcaagccatagagtcgcctgtccgtcatctgcgttatggcacggtacggataccgccattctcgccagcgtcatgtttgtacccttgctggtctgttttacctgcgggtcgtccaccagccgcccgtaagctgcaatctgtgctgtcatggtctgcgctccttgttccggtactcctggataatatccattgtcatatcaaataaatcacacgctgctttttctgcgtcttctgctttcaggtcatacagcgtcatgaaatggtgagtgattgcccgtgcggctcttttgctgtttgctgcatattgctcatagattttttctgccctatcctcaatgtctcgccggaattcttcacgctcaaacaggtcgcggtgtatcaacaccagcgagtcattcagccatgtcacatcggcgtagactgttcgcttccagacaatcaggatcgggatatgattttcatcgcagtaatgcagatgttttcctggcactaaaagcactggcctgcctcgtgccgatacgaacttcacaacagatccctgttcggttaaatcgatggcgggtgagtgtgattttttagcgtgtttctctgtcataaaattttcctcaaaggaataaataaaaatttatgccaaaagactgttcaactgttcatcttttgctatttcatctttaaattcatgaggttaaagggtgaacactttttgtaaaggtgttcaccaactgttcaccctgttcacccgctcgccgttcaaaaatcaaacaaaagggtgaacaggtgaacactccggtgaatagttttacaaaactattcacccattaacttactgatatcaaatgtatttgtcacagggtgaacagcggtgaacagtttttctataacttaatttttatcaccctcatttttcactggtgcacatgacggcagccagtcctcagactcatccatcagtatcacgtttgatcgcacaccttctttcgttctctttttcatatactccctgccatattccgccattgcgcctggcatatctgcaccgaagcgcgtcagtgttacgggcttactgaaaccgtgcgccctcatatacgagagataggcgtgatagagataacggcgcggactgaacggaataatctcagcattaccgactaacaggccgtcacacattaccgacgacatgagatagccgcagaagtccaccagcgaatccccctcacgctttattgcaagggcttcttctgatttctgctgctcatgtaacaggcgtctggcttcgtcctggtcagaaaagcgcgtaagcagatgacgaatcactacagcaagctcaccctctattttttccggcagcatcggatcgcgctcgttttccggtacaacctccgaaaaattgaatatcacacgacgacgcgagatccccccgctgcggtcactgaatgacatggcgctgttgttaaccgccagcactaccgccggaatacgcgttgagtatggcgctttgtgtttcgggtcaattgccaccttgtcaccgcccgtaatggcctttattcctgctccatcacccgcgtagcgggtcatatccggcagaataatcagtgaaaagccaaccactaacgcgcgttcccttgcatcctccagtgccttcatgcttgccgataccgtgttggccttacccgccagcatggtacaaatctccgccataacgcttttaccgcttccaccaggaccagttacctcaatgaataactgccagtcgtaccggttcgccagcaccataaataacgctgccagtacgcgatccgccttgcggtcattctctgccaccgaacggcgcaaccatttccagaaattcggcgcatgtgttgccagcgtttcaccctctgctggtggagtgaacggtaactcactggcaattaacagccagtcatctttatcgtgttcccgaaaatcacctgtacgggtatcaaataccccgttgctgaatccaatcaggtgacgggcggtattacccattacgggtaaacttaacttcattgtgtcaactgccgatttaatggcgttttgtgaatagcagatatcttcgtcaatgaagatttgcgccattgtgcgctgtagctctttgtcctgcacgggggaccatataaccccgttgtaatagtgaactgtgtcagagtcagggtttattgccagttcccctccgtaatgagcaagaagaaccctgccacgctggctggcccccatctggttaagtgccagtgacgaatcatcaccctgtccccgcgcttttttctttacaggcagctcaataaccagcccgtcagaaatgtttttgcgttcaatatccagatagttacgccagttctgccgctcgttgtggtgcattccttcagggtagtaatcagcatcctgtatacctgcggctgccagcttctgaccgatgcctttgaccatcatctgatcgaggtgtccggccttgtatatacgcgctgatttgcgcccgtcgggcacaattttcagattgccaatatccttaagttgttcatcagaaagcacgactggcggaacatcatcacctgcaagtcgtccctcctgctcctgccactgtttcgcgtgcgcccacgcatcactgccagcgaaaataatcacttccgtatcggcgtgttttttccctcgcggctgtttttttaagttcggtgcgcttttcatttcttacctctgctgatcgtcttcttcatggccttaacatgcgcctttgctttgttgttgctggttgggctacgacgtggtacggcctgcaccagggaaaaatcacgccggaactgacaaacaggcatcacgcagtcatagtcatacccttcacggcggtaggtgatgcgccgttccctcatgctgataatcatcacgatgccgccgtacttatcgcggtaaatatccccgcgcataaattcgggttgagttttgccactggcagttaagccagtattttttgatttcatttaattaatctcctgaaggcgtcgtcttaatctttatttcctgtttatttttctccgttattgttcagcgcgtttttcttcctccgtcattaaccataccgccacatttgcggaaagttgtttaatcagtcccgcaataacagaaaggtcatggtcgtcaatttcttcgtggttacgttctatcatgcgctcaatcatgcggctgattacttcgacctgctgcgctttcagtgatgcttctgccagtgttatttcctgcattactgcaccccatttatttcatgaacggcgtggataattacgccggataaaccggctttagctgatttgttaattactgtgctgattgcagcctggacgttttcggccttcacgttctgcgtgatgccaacggtatagccgcgattattaacagcacgggaaaagacgcggaaggttttaagcatgagtcacctcctgacggatacgggcgacaaaaatcagatgtgcgtgcggcagctgcgcgcgtgcttcgcgctcagtggcagctgtaacggtgaatattgcaatgctgcctgtcaggcactgcataaagcgccagacaaagtaagggcgtgcagatacagccatgtgaaaggcacctctgactttgggattatacccaccgcccaagaggccaatcttgctggcggtggactgtacggaattggccttactggtgttagaggaaaccagccttcccgaaggaagttccatacagcccaccattgttgaggtgtgcgtgtgcgccgatacaaaaaaagacgctggcgcgtcgtgtatcgcctctaactccagcgggaggccaatcccgatccccgttttataagggatagcctcagtatatgccgcttttttgcttaagtggtcggatgtgttgcgagaaaagtttgtgcgaaaaatacctgcgttttctttgaaagcacataataacatcacgttatttatgtttatgcagtgtgtcgcaaagcgacctgaatcatcacgcaaattacaaccataaaaaatacctgcgctgtgatatgaggtactacagcgcaccgctttacgggtacagacaatgaccaacgaagaattacaggcaatcgcattatccatacttgagcgccagcgcgaaaaagcacgccagaagcgagagtatttgcttaatccacctcctctcaccagaccaaaacgatttgcgcttgaagcatttctggataaatgccctcggcggttaatctcgcctaaaaaccgatagcgatccgcttttgcttctccgactccataaagcgaataaaaaccatcagcgccgtggtgtgaggtactgcgtcgctcagctgtacaggaaataagtatggatttatcaccagacgatgagaaatttttacgacaactacaacaccaactactcatggatgccattgtcgagcagcaaacaaagagcagcccgatagattcatcgctgaataaaaaggccgcctcccgttttattgaaaacaggataaggcgcggaaaaacatgtgacgacgagtcaaaggcatcgcatacaagagataaaaaatttgcacttgaagagtttctcaggaaatacccacggcggctaaaagcaaccaaaaatcgcccgccaggctgatagcattgtccaccagctacactcatggcatagttggtgatgcgcttgatttcctttatctccactggcgacccttccatggtcgcctttgttttgcctgtcattcctgcatcatgcggatattcgcgccgtacagggccgccagcgcgataatttgataaaacctccccaagtattgcttaacgtgtttcatgcgctcagcggcgaaatggctcacgatatggcgcatgtaatcagcatggttgatgttcagtagtgcgaacttatccgccgtgtcgatgtaccggacggcaggtttgaggatgtcaggcatgttcacgttctcccaggcgacgggccagccagcgttgggctaattcggtgagacgttctttacgttctggcgttggcatatccatatccagtagcgcacagttacggctttccagatacgcgagcaacgccagttgatcagcggttatatggtcacgaactttttttgatgggatgccgttttttttggcccatacaggcgggtgcatccctaatacaaggcgcgcaatgaaagtacattcgttgttataagcatgaccgtgttgagtgtctccagtacgctctatgtatcccttcatggcatcccccatagagcgcatctcagctttggcctcacatctctctgctatccagttagccatgcggttaaactgcgcaatgtatgcctctttgaatgcagccgctttttttccggtaaatcccattgttaaaaacacgaagccgtctttggtgacttcgtaggctctcaatacgcgccccttatgctcaaatttaacccgccgaaaattgcgggttaaaaattcagcagaacaacacaggttttcaatccggttaacaaccttatcgtgatcctttctgaaaaatcgggcgatagcctgtgaagtggttacaggctcaccgccagaaggaaacacttccggcgcagtgagtgcatttttatttattccgtcagcaataatctcattgccggaaattaccgaaataattgcggcgaaatcataattacgcatgattcacccccagagacggcgctgacgtcatcaggctggcgaacgtctccatgcggcgagcaacttcccgcaccgcttcggtcggtgtcatgccgttctgtatcgcctcgttaaaagccgatatcccgatttcttgtacaactgacaacaaatgaaagcggtgttttgtttcgtcctgcttgaggtggcgcatatgttctgggttacgaccgcgaacaatgcgtaacaagtaatcatgttgcatttcattcagcatatagcgcatttctgggcgaccgcgcttatggcctgatttcagactatagcgaggcaatgctcccagatcgcgtaactgctgctgatgttttttgatcgtcgcgcaaagactttcgtgttgtattcctgctcgctcagaaataacgcgggaatcaatacgcgactctgctttgtggcgaatcaatatatcgttctggttgatttcaggctgaacgaagccctgcccctgtacgggcatattcggacgtttcattgaaaactcctgctatcggatcaggtttagtgctgggggagaatatccccctcccaaaagattattacgcggcgttgttgcgagaagcatcaatacgctggttaatccattcgtcgacttcactttcaataaaagccacggagcggggaccaatttttaccggtttagggaagcgccccaggctgatcaggcgataaatccatgcgcgaccgtaaccagtacggcgcataacctcagaaagacggatgaatgaattgttattagccatttatcaatctccttaatgttgacgcggaaatcccctcctgtggcttagcaagagttttatttgcgtcaaattacgaacacgacaaaaaccacaacatgaaaacatgttgtggtattgcataagataaattcagattgtttggttggtatgctccagcaaggtagagctattcccgctttcggcggggtcacacgattaggcgtgacgtccagtagttttaaagagcgctttttcagtacatggtggacggacaagagagcaattgcgctttgtcagcgccgtagattcatatttgaatcgttgtatgtttcccgatagcaaatctatcggtcactgcgggacgaaccatcccgccgcatcaatgttaaagatcaacagcactttgccagcgctccaccgcctcatggatgaatcattacatgctttgtaatagtgcatgtatcaccattctttcctgcatcaggaaagcactaaaggctgttaaagagcatccagcttttcagctgcgtagaaaactcaatcttcgttgttacaaagagcgcccatacatgacggataactgcgtgaaaaaccctctgtaaggatgttagctgtagctttccgtgtacgttagcatacatctgtatacttgtccagtcgtttttatgcacatacactaaacttgccgtgcaccacgtttccgccctgttccagtgagtccatatagtcggcgtaccactggagcatctcccgccgtccgtccagatattgcgcgtgattgtatgtgccacggatcgagtttttatcgacgtgcgccagctgcgtttctatccacgcggagttataaccctgctcatgcaaaattgtactcatggtatgccggaacccatgaccagtaacgcgcccagcatagccaatacgacgaataagcacgttcatcgccatttcactcatcggtttactgtgctgtattcgaccagggaaaataaacggatactgccccgtcatgtgtttcagttgttccagaatagcaatcgcctgttctgaaagcggcacgcaatgaggacggcgcattttcattcgttctttcggcacttcccacagacgattatcaaaatcaatctcctgccactctgcctgccgcaattcacccggacggagtcctgtaagaatcaacaatcgcatacccagcttgacgatctggcttccggtgtacgtattaaaaacgcggaaaaattccggtagctcatcaactttcagatacgcgtaatgctcttttttgtgtggtgcaaatgcgcttgccagatcaggagcggggttatattcagcgcgtccggtaattattgcgtaccgaaacacttcgccacatcgctggcgaaccttacgcaatttttcagttgcgccacggtcattaagacgggatagaaccgcgagcaattccatcggcttaatctctgcgatgggcctacctccaatgtacggaaaaacgtctttttcaaacgtctctatcatttcctctgcatatgagggagaccatcggtccaggcgtttttcataccactcacgggcgatcacctcaaaggtgttaccgcatttgttcgcctgttctcgcttttgggcctttctgacctcactcggattaactccaccagcgataagccttttggcttcatcccttgccgtcctggcatcagaaagggacacctcaggatagacacccagcgacaacattttgggcttgcctgcaaacctgtatcgcaatcgccagcccttcgaaccgttcggctcaatgagtaacgaaagcccgttgccgtcattgagtgtataggctttctcttttggcttcgcgcggcggatagcaaggtctgaaagcaacatgtgtatagcccccaaaaaacgattttgtcctatacgcattactatacacttctgtgtgtagatttaggtagatgactgtagacggttgtagacgaggaaaaacgctggaggccttgatattcgggggattggtagactttagtagacgttggtagatgtttgtttggagcgggcgaagggaatcgaaccctcgtatagagcttgggaagctctcgttctaccattgaactacgcccgcttcgagatgcgtaaggcattataaaccttacgctctccttagcaagtaccacgctgctgactgctgattaattcaccatcagcattttggcttgctgccctgaggcggcaagtaacgtagcggatcaattgccgttgcacggtaacgaatctggaaatgcaggcgaacagatgccgcatcagcgctccccatagtggcgattttttgcccagctttcacgctttgcccattatttaccagcatcgtgtcattatgagcgtaagccgtaatgtaatcttcactgtgtttaatcatgatgagattaccgtagccacgcagctggttacccacatacaccacctttcctgcacccgcggcgtaaataggtgtacctcgtggagctgagatatcaatccctttattgccgccatctgctgtcgaatacggcatgataactttccctgtcgttggccataaccaacaacgttgccctactggcggccaggaagatttcggtaccgctgatgacggtgtaaccgatgcggttttggtcgttgatttggcggttgatttacgtgtactactgctacttttcgccccacccagttttagtttctgacctacttcaatggtgtaagggggggaaatgccgttcagtcgcgccagttcttttacgctggttcccgtggtgcgcgaaatacgatatagcgtatccccccgtttcacggtgtaaacggagccggaatacgttcctgtatcggatgatttgctacccgaacagcccgccaaaagcagtccaaccgataacaacatcacgatacccagagattttttattcaggcgtcccgcactcaaaatctttcctcgcttaaaaaacaagacgccatatcatagcagccagcctcttgatacccaatctcttgcttctggaaaaacgatgtaatagagaaagaggttaatttcatttggcaaagggaagtatcatcagcaaaatatttgctgtagtggtatcgaagttcctgacttttaccctatttcccaccttgatgcgtaataatcctaatttatcacattgattttatcgccactcatattgatacgtatcactgtccctattcagagtcctgtttcgtatcatatctgtgtttttttaacgtcatcacacttccttcctccccgaacgcttatcgtcgtttctggcgtaaatcttgcctgcttagactaaatctttgccataagaaccaaatgttcaaatcgaggggatttctatggaagcgcgggaagcaaccgctacgggtgaatcatgcatgcgcgtcgatgccattgctaaggtcaccgggcgagcacgatatactgacgattatgttatggcgggcatgtgttacgcgaaatatgtacgtagccctatcgcacatggttatgccgtaagtattaatgatgaacaagccaggagtttgccgggcgtcctggcgatttttacctgggaagatgtgccagaaatcccattcgccacggcagggcatgcctggacacttgacgaaaacaagcgcgataccgccgatcgtgccctgctaacgcgccatgttcgtcatcatggcgacgccgttgccatcgtcgtggcccgcgatgaactcacggcagaaaaagcggcgcaattggtcagcattgagtggcaagaattacccgttatcacctcgccagaagcggcgctggcagaagacgctgcaccaatccataacggtggcaatttactgaaacaaagcacgatgtcgacgggtaatgtccaacaaacaatcgatgccgccgactaccaggtacaggggcactatcagactcccgttattcaacattgtcatatggaaagcgtgacatcgctggcatggatggaggatgactcgcgaattaccatcgtttccagcacccagatcccgcacattgttcgccgcgtggttggtcaggcgctggatattccctggtcatgcgtacgagtcatcaaaccgtttatcggtggcggttttggtaataaacaggatgtactggaagagccaatggcggcattcctgaccagcaaacttggcggcattccggtgaaagtttcccttagccgtgaagagtgtttcctcgcaacccgtacccgccacgcttttactattgacgggcaaatgggcgtgaaccgcgacggaacattgaaaggttatagtctggatgttctgtctaacaccggcgcttatgcatctcacgggcactccattgcttctgctggggggaataaagtcgcttacctttatcctcgttgtgcctacgcttacagttcaaagacctgctataccaacctcccctcggctggtgcgatgcgtggttatggcgcgccacaagtcgtatttgccgttgagtctatgcttgatgatgccgcgacagcgttaggtattgatcctgttgaaattcgtttacgcaacgccgcccgcgaaggagatgctaatccgctcacgggaaaacgtatttacagcgcagggttgccggagtgtcttgaaaaaggccggaaaatctttgaatgggaaaaacgccgtgcagagtgccagaaccagcaaggcaatttacgtcgtggcgttggcgtcgcctgttttagctacacctctaacacctggcctgtcggcgtagaaatagcaggcgcgcgcctgttgatgaatcaggatggaaccatcaacgtgcaaagcggcgcgacggaaatcggccagggtgccgacaccgtgttctcgcaaatggtggcagaaaccgtgggagttccggtcagcgatgttcacgttatttcaacccaagacaccgacgttacaccattcgaccccggcgcatttgcctcacgtcagagctatgttgccgcgcctgcgctgcgcagtgcggcactgttattaaaagagaaaatcatcgctcacgccgcagtcatgctacatcagtcagcgatgaatctgaccctgataaaaggccatatcgtgctggttgaacgaccggaagagccgttaatgtcgttaaaagatttggcgatggacgctttctaccaccctgaacgcggcgggcagctctctgccgaaagctccatcaaaaccaccactaacccaccggcgtttggctgtacctttgttgatctgacggtcgatattgcactgtgtaaagtcaccatcaaccgcatcctcaacgttcatgattcgggccatattcttaatccgctgctggcagaaggtcaggtacacggcggaatgggaatgggcattggctgggcgctatttgaagagatgatcatcgatgcgaaaagcggcgtggtccgtaaccccaatctgctggattacaaaatgccgaccatgccggatctgccacaactggaaagcgcgttcgtcgaaatcaatgagccgcaatccgcatacggacataagtcactgggtgagccacccataattcctgtagccgctgctattcgtaacgcggtgaagatggctaccggtgttgcaatcaatacactgccgctaacgccaaaacgattatatgaagaattccatctggcaggattgatttgaggataacatcatgtttgattttgcttcttaccatcgcgcaaccacccttgccgatgccatcaccctgctggctgacaatccgcaggccaaattgcttgccggtggcactgacgtactgatacagcttcaccatcacaatgaccgctatcgccatattgttgatatccacaatctggcagagctgcggggaataacacaggcggaagatggcgcgctgcgaatcggctccgcgacaacatttactcagctcattgaagatcccgtaatccaacgcaatctcccggcgttatgtgctgcggctgcatcaatcgccgggccgcagatccgtaatgtcgccacctacggcggaaatatttgcaacggtgccaccagcgcagattctgccacgccaacgctaatttatgacgcgaaactggagctccactccccacgcggtgttcgtttcgtcccgattaatggctttcacaccgggccgggcaaagtgtctcttgagcatgacgaaatccttgtcgcctttcattttccgccacagccgaaagaacacgcgggcagcgcgcattttaaatatgccatgcgcgacgcaatggatatttcaacaattggctgcgccgcacattgccgactggataacggcaatttcagcgaattacgcctggcatttggtgttgccgcgccaacgccgattcgctgccaacatgccgaacagactgcacaaaatgcgccattaaacctgcaaacgctggaagccatcagcgaatcagtcctgcaagatgtcgccccgcgttcttcatggcgggccagtaaagagtttcgtcttcatctcatccagacgatgacccaaaaagtgattagcgaagccgtcgccgcggcggggggaaaattgcaatgaatcacagcgaaacaattaccatcgaatgcaccattaacgggatgccttttcagcttcacgccgcgccaggaatgccgctttcggaactactccgagaacaagggcttcttagtgtcaaacaaggttgctgcgtaggcgaatgcggtgcctgtacggtgctggtcgacggcactgcgatagacagttgcttattccttgcggcctgggctgaaggaaaagagatccgcacgctggaaggtgaagcgaaaggcggtaaactttctcatgtccaactggcttatgcgaaatccggcgcagtgcaatgcgggttttgtacgccgggcctgattatggctaccacggcgatgctggcaaaaccacgcgaaaaaccattaaccattacggaaattcgtcgtggactggcgggaaatctttgtcgctgcacggggtatcagatgattgtaaatacagttctggattgcgagaaaacgaagtaaaaggatatccggcctgaattcaggccggattctcagaggttatgtgtttaacaactcatatttcttaatcttgcgatagagcgtagcaatgccgatgcccagttcatcagcaacttccttcttgctgttatgacgtgaaagcgcctcgcggatcatttgcttttccatctcctccagcgccgtgccgcccgcatcatcgagtgacaggtgcgcctcactgacctctgttacatcactttgctccgttgtgccatcattcagcagatttggcggcaatagcgtgctgtcgataacttcacctgaaggaacaacgttaaccagatattccatcaaattgcttaactcgcgcaggtttccgggccaacgatgcttacgcaatatttcgacgacatcaggagcaatgccaggataaaccgatcccagacgacgggtatgcagatgtaaaaagtaatgcaccagtaattcaatatcttcctgacgttcacgcagcggtggaagagttatcgggataacattaagtcggtagaagagatcttcgcggaatttaccttcggcaatgaactgggccaaattctgattagttgcagaaatgatgcggatgtcgacttgtattgggctactggcaccaatcggcagaatttcacgcgcctcaatagcgcgcagtaatttagcctgcaacattaatggcatatcaccaatttcatcgagaaacagcgtgcccgtattcgccgcctgaatcaaccctgttttaccgttggcagaagcgccagtaaatgcgcctttaacataaccgaacagttcgctctccagaagctgttccggaatcgcggcacagttgatagcaataaagggtttattccgtcttccgctcaacttatggattgcacgggcgacgacttctttacctgtgccgctttcaccaaccaccataacgctggatgggctgggtgcaatacggctaatgagtcgttttaattgccgcataacacggcactcgccaaccaattgttcaatatgcggttcatcaggtgcatttgctacagaaaaactggtatgcgattggtgaaacgccattaaaaatagttgtcggccctggatgttatgcaactgaccaatgattaattcacttttatcatcccacgaaacaatatgttgcatatgaccatgggtaaaattactctcaaatgttaatggtctgaaacgaacaggttttccaataatattattttgtacaacaccgagtgtttttaaagctgtctgattaacaaattgaacacgattatcagcatcaaccactaacacgccctgatccatattatcgatcatggtcgcgaatattttactgatgttatctcctggtccctgatcctccagaagtttagaaacaaaaatggtggatatatggcgaacgtaatcagaaaattcgcgtaaattatcactaatatgctcttgttgctcgtgggtaacggcaatcaaacttatcactccaacacaacgatcctgtaaaatgacaggcgtacccagaaatgctttttcgcggcaattttctttactatcgcaaccttcacaaaggggatcgaagcgagactgtgtcacaactttttcagttttcgtttccaggacgtggcggagcaggcgtgagttgccgctcaactggcggccaagaaacttcccatacgcgcccgttccggcgacgcgacacaagttttcatcaacgatctcaacctcaagctgcaaaacgctggcaagcattctggcaaaacgctgaattgtcggttgaatttgcatcaatactgactgcgtagtcgcaagctccatagctttaccttccagacttacttaaaagtcgatcattgaagacgttgatggttcacagatcatgatgatattaactcaggcgaaattggctttgataaaaacataagatttttatcactttctaataaaattatggaagagatatcacatttctatatcaatatgagaattacagcggcaagtttatcaaactgaagagagatagcctgcctctttatcttatttctgatacttagcagcaaataaataacgtgataaaaaaagccaaacgttttcgtattttaaaaacaaccggaaactggcatcaatatgtgatcaaccccacacattatccgtcaaattagcctttcgcagccgcgtggataattctggcacacttattgttagtcccaggtatagctgtgaaaacaccaatcactttggcacgtcacagtgaaataaaccactttgcctgtcattccactatcgggactttatgatgaaaactgttaatgagctgattaaggatatcaattcgctgacctctcacctgcatgaaaaagattttttgttaacgtgggaacagacgccagacgaactgaaacaagtactggacgttgccgccgcgttaaaagcactgcgtgctgaaaacatctcaaccaaagtctttaatagtggattaggtatttccgtcttccgcgacaactccacccgtacccgcttctcttatgcttccgcgcttaacctgctcggccttgcacaacaagatcttgacgaaggtaaatcacaaatcgctcacggcgaaaccgtgcgtgaaaccgccaatatgatctccttctgcgctgacgctatcggtattcgcgacgatatgtatctgggcgcaggcaacgcctatatgcgtgaagttggcgcggcacttgatgacggctacaagcagggtgtgctgccgcagcgtccggctttagtgaacctgcaatgcgatattgaccacccgactcagtctatggctgacctggcatggttgcgtgaacactttggttcgctggaaaacctgaaaggcaaaaaaatcgccatgacctgggcctactccccaagctatggcaaaccgctctctgtaccacaaggcatcataggtctgatgacccgcttcggtatggatgtcaccctggcccatccggaaggctacgacctgatcccggatgtcgttgaagttgctaaaaacaatgctaaagcctccggtggtagcttccgtcaggtcaccagcatggaagaagccttcaaagacgcagacatcgtttatccgaagtcatgggcaccttacaaagtgatggaagagcgtactgaattgctgcgtgcgaacgatcacgaaggcttaaaagcactggaaaaacagtgtctggcacagaacgcgcaacacaaagactggcattgtactgaagagatgatggaactgacccgtgatggcgaagccctgtacatgcactgcctgccagctgatatcagcggcgtatcctgcaaagaaggtgaagtgactgaaggcgtattcgaaaaataccgtatcgctacctacaaagaagccagctggaagccttatatcatcgccgcgatgatcctgtcccgtaaatacgccaaaccaggtgcactgctcgagcaactgctgaaagaagcgcaagaacgcgtgaaataacccctcgggccgatcagctggtcggccctctatttccagaggccaaaaggataggatatgtccgttttctcattgaagattgatatcgccgataacaaatttttcaacggcgaaacatcaccgcttttttcgcaaagccaggcaaaactggcacgccagttccaccagaaaattgctggttatcacccaacaccgctttgtgcgctggacgatctcgcaaacctgtttggtgtaaagaaaattctcgtcaaagacgaatcaaaacgattcggtctgaacgccttcaaaatgctcggcggtgcgtacgccatcgctcaattattgtgtgaaaaatatcatcttgatatcgaaacgctgtcatttgagcacctgaaaaatgccatcggcgaaaaaatgactttcgcgactaccaccgacggcaaccacgggcgcggtgtggcatgggcagcacagcaactcggacagaatgcggtgatttacatgccgaaaggttctgctcaggaacgcgttgacgccattctaaacctcggtgccgagtgcatcgtcacggatatgaactatgacgataccgttcgcctgaccatgcaacacgcgcagcagcacggctgggaagtggtacaggacacggcatgggaaggttacaccaaaatcccaacctggatcatgcaaggctacgcaacactggcggatgaagccgtcgagcaaatgcgtgaaatgggcgtcaccccgacacacgttctgctgcaagccggtgtcggtgcaatggccggtggtgtgctgggttatctggtcgacgtctataacccgcaaaatctgcacagcattattgttgaacctgacaaagctgactgtatttatcgctccggcgtcaaaggcgacatcgtcaacgttggcggtgatatggccaccatcatggcgggcctggcctgcggcgaacctaacccactgggctgggaaatcctacgtaactgcgccacccaattcatctcctgccaggacagcgttgccgcattaggtatgcgcgtgctgggtaatccgtatggcaacgacccgcgcatcatctccggtgaatccggcgctgtcggtttgggcgttctcgcagcggttcattatcacccgcaacgtcaaagcctgatggaaaaactggcgctgaacaaagatgccgtggtgctggttatcagcactgaaggcgacaccgacgtgaagcactaccgcgaagttgtctgggaaggcaaacacgctgtagcaccttaatcaccctattggaactgctccctgcaaaacggggagtaaaaaatctggagaaaaataatggctaagaatattccattcaaactgattcttgaaaaagcaaaagattaccaggcagacatgactcgcttcctgcgcgatatggttgctattcccagtgaaagctgcgacgagaaacgcgtagtacatcgtattaaagaagagatggaaaaagtcggcttcgataaagttgaaatcgacccaatgggcaacgttctcggttatatcggccacggcccgcgtctggtggcaatggacgctcatatcgatacagtcggcattggcaacatcaaaaactgggacttcgatccgtatgaaggcatggaaaccgacgagctgatcggtggtcgtggtacttccgaccaggaaggcggcatggcgtctatggtatatgccggaaaaatcattaaagatctcggtctggaagatgaatataccctgctggtcaccggtactgtgcaggaagaagactgcgacggtctgtgctggcaatacattattgaacaatccggcattcgcccggaatttgtggtcagtaccgaaccaaccgactgccaggtataccgtggtcaacgcggtcgtatggaaattcgcattgatgttcagggtgttagctgccacggttcggcaccagaacgtggtgataacgccattttcaaaatgggtccaattcttggcgaattacaggaactgtctcaacgtctgggctatgacgaattcctcggcaaaggtacgctgactgtttctgaaattttcttcacctccccaagtcgttgcgctgtagcagacagctgcgcagtttcaatcgaccgtcgtctgacctggggcgaaacctgggaaggcgcgctggacgagatccgcgctctacctgcagtacagaaagctaacgcggttgtttctatgtacaactacgaccgtccgtcctggactggcctggtttatccaaccgaatgctacttcccgacctggaaagtggaagaagatcacttcaccgttaaagcactggtgaatgcttatgaagggctgtttggtaaagcgcctgtcgttgataagtggaccttctcaactaacggcgtatccatcatgggtcgccacggcattccggtcatcggttttggccctggtaaagaacctgaagcgcacgcgccaaacgaaaaaacctggaaatctcacctggtaacttgtgccgctatgtacgctgcaatcccattaagctggctggcaaccgaataattactcttcacttattccccctccggtttaccggagggtttttggagtttgctatgcgcgtattgataaaaaacggcattgttgttaatgcagatggacaggcgaagcaggatttgctgattgaaagcgggattgttcgccagttgggtaccgatatttcgccgcaactcccttgcgaagaaattgatgcctctggctgttacgttttccctggcggcgtggatgtccatacgcatttcaatattgatgtcggcatcgcgcgcagttgtgatgatttttttaccggtacccgcgctgctgcgtgtggcggtacaacaaccattattgaccatatgggatttggcccaaatggctgccggttacgccatcaactggaagtttatcgcggttatgccgcccacaaagcggtcatcgactacagctttcacggtgtcattcaacatattaatcacgctatcctcgacgaaattccgatgatggttgaggaaggactgagcagttttaaactctatttaacctatcaatataaactcaacgatgatgaagtgttgcaggcattacgccgcttgcatgagtccggcgcgctgaccaccgtacacccggaaaatgacgcagctatcgccagcaagcgggcggagtttatcgccgcagggttaaccgcgccgcgttatcatgctttgagtcgacctctggaatgcgaagcggaagccatcgcccgcatgattaacctggcacaaattgccggtaacgccccgctctatatcgtgcacctgtctaacggcttaggtctggattatctgcgtcttgcccgtgcgaaccaccagccagtctgggttgaaacctgcccacaatatctcctgttggacgaacgcagttacgatacagaagatggcatgaagttcattcttagcccaccgctgcgtaacgtacgcgagcaggacaaactgtggtgtggcatcagcgatggtgcgattgacgtggtggcaaccgatcactgcaccttctcgatggcccagcgccagcaaatttctaaaggcgatttcagccgctgcccaaatggcttacccggtgtggagaaccgcatgcaactgctgttctccagtggcgtgatgacgggacgtatctcaccggagcgttttgttgagttaaccagtgcaatgcccgccaggctgtttggcctgtggccgcaaaaagggatattagcgcccggttccgatggtgacgtggtgattatcgacccacgtcagagccaacaaattcagcatcgccatctccacgacaacgctgactactcgccatgggaggggtttacctgtcagggcgcgattgtcagaaccttatcccgtggtgaaacgattttctgcgacggcacctttacaggcaaagccgggcgaggtcgtttcctgcgacgcaaaccgtttgtccctcccgtgctctaaccactgccagggatctatacacaatcaagaatgatgagtgaggaaaaatgagtaagaaaattgttctcgccctgggcgggaatgcgctgggcgatgacctggctgggcaaatgaaagcggtaaaaattacttctcaggcaattgttgatttaattgcccagggacatgaggtcatcgtcactcatggcaacgggccacaggtgggcatgattaaccaggcctttgaagctgcagcaaaaactgaagcgcactcgccaatgctgccgatgtctgtctgtgttgccttaagccagggttatattggttacgatctacaaaacgccttaagagaagaactgctttctcgtggcattaataaacctgtagcaacgctggttacccaggtcgaagtcgatgctaacgatccggcattcctcaacccgaccaagccgatcggttcgttctttaccgagcaagaagcagagctactgacaaaacagggttacactctgaaagaagatgcgggtcgcggctatcgtcgtgtcgttgcttcgccaaaaccggttgatatcattgaaaaagaaacggttaaagctctggtagatgccggacaggtggtgatcaccgttggcggtggtggtatccctgttattcgtgaaggtaaccatctgcgtggtgccagcgcggttatcgataaagactgggccagcgcccgtttagcagaaatgatcgatgccgatatgctgatcattctgactgcggtagaaaaagtggccattaacttcggaaaagagaatgaacagtggctcgatcgcctgtcgttaagtgatgctgaacgctttatcgaagaaggtcattttgcgaaaggttctatgctgcctaaagtggaagctgccgcctcgtttgctcgctctcgcgcaggtcgtgaagcactgattaccgtattgagcaaagcgaaagaagggattgaaggcaaaaccggaacggtgatttgtcagtaatttaaaggccggatgggtaataccatccggccattttcatttaagccacttccagcacttcttttgtcgctttaacgccctgatgcatcaacatcattaacgcctcaagtacgccgccgccaatcgcccgggctttatcagaaacgctggtgaaatcagccgtttcaccacgaggatcgatatcaccaattttaaaaccaccgaccacggccagtccgtcgttcaacaagccacgcaccatccccgtcaacggtgctttaatttcatgctcaccaatccaggcaatgacatcgccctctttcaccagatcgcctaatttcacgttggatcgcataatgcctgcagcaggagcgcggatcactcgtcgggtggtatgccccataatattgccgggaacaccggtattctcctgcgcacaacctgagtaaatcacctgaccgagccagtgcccgcgatttgtttcaattaccgcatgacaatccttccctgcagtaaagcccggcccaagcgcgattgttactggtgccatatctgcccgcgttcccaaattctgtttcgccagaatagcgtccaccacgcaaagcggtttcagttcatcaagcaatgaacaggtgggatctaccatcacagggataaatccgcgttcggtaagtttcatcgcttccgcagagctggttgccaggcgggcggtgacgccttcgaccgtcatttcgccatcgaacacggcctgggcaaacgccacggtacaacgaatcactgtcggtttttccacttccaacatgatcactttaaaacccgcatgatacagacgtagcgctacaccactggcgatatcccccgcaccgcgaatcaccaccagctggtgtccggaaggatgagaaggcttcatcatcagcccacccggcgcgttatttttcacctgtaatatttctgccagcacgctgatggcgatctcttgcggcgtttccgcacctatgttgtaaccaacgggcgcatgtaaacgggcaatatgttcttcagccacgcctttctcacgcaattggcgcaggaaaagctgaaccttgcggcgacttgccagcaaccccagccatgcaatgggttgttcaatgagtttgtcgagggcttcacgatcctgattattcgtggcaatcaggacaaaattatcagggcgaatatccagtgcttccactgccgcaccaaacgactcagcatggagaagcgtggttgatggtgggaatagttcaggattgaggctttcgcgataaatatcagcaacggcgatatcaaatcctaatagcgccgcactctgggctatcgcccggttgacatgccccgcaccaatcaacaccagacgtggacgcataccatggacgctgataaatactgacattgcacctccacaatctgacccgacagcatccgcaccgttacgagccatacgtccatggaataatcgcggcttacgttcctgcaatgcctgaagcgactcttcaatcaccttccgttcaaccattccgccaccaattgtaccgacgatagaaccatcggcgcgcactaacatttgtgcagaatggcggggggttgagcctcggctatcaacaatttgcgccatcgcaaacggacaattttgctcttcgagttttgcagcctctgtgaaaatattcataccaacctcaatggatatcctttcagtaacccggaatacccgggccgctaattcacaaatctgcgcgcgattgcaggatgttcttgtatatcgcccagccagattgcctctacgttgtgttgttgcagcggttgaaggagctcgctttgcgcaatcgcattctcacattgagaaaaacggttaatgaaccagactcgccgacaaccttgcggtacgtttttaaacgccccctgagggtggcgaaccagcgcaacgagatcgctcagttgcaagggtgcatcaggtgttaacccagtaatatcagcaaactgcgaccagcgatggacattttctgtgctcactttctcacccaaaatatgtcctcccatcacagcaatcacgcagcaactgcttttaggtatgcaaggttcgtgctcatcaggcgcttttaacggcattccacgcgagccatctgcctcaatgagaattacgtcacactctggtcgttgtaccagtgcatcaatcgcttctggcgtaaatccctgcacttttccctggttcgctttccagcagtgaaaacaaaatgaaatgggggatataaaagacgcatgaggaagcatggcgggatcacgacagaaaaccacgggccagtgagatgttggcataaacatatgtgtcgtcgtagtgattaatacacgcctaccactcgcctggaacagttctgccagccaaaaaagcaagctggttttccccccagcaccaacaatagaaatcacagtgggacgtttctgcgcgcctaaatcaatgaataatgccgatgggtcaattatacttttcacgcgtctttatggacctctctgggataaattaccctcaacgtaatccatcaggaagtaacgcaattatcaggcgttattagctcctgtaaataatggaatcactatgtcagccatcgactgtataattaccgccgcaggattatcatcaagaatggggcaatggaaaatgatgttaccctggcaacagggaacaattcttgatacaagtatcaaaaatgcgttgcagttttgtagccgaattattttagtcaccggctatcgtggtaatgaactgcacgaacgttatgcgaaccagagcaatatcactattatccacaacccagattatgcgcagggtttactgacatcagtaaaggccgcagtacccgcggtgcaaacagaacattgttttctcacccacggagatatgccaaccctcaccatcgatatttttagaaaaatctggtcgttacgaaatgatggcgcaatactgccactccataatggcatccccggccatccgattttagtgtcaaaaccatgcctgatgcaggcaatccagcgacccaatgtcaccaatatgcgtcaggcactccttatgggagaacattattccgtcgaaatagaaaatgcagaaataattttagatattgatactccggacgactttattacagcgaagaaaaggtatactgaaatttagaaaacgtagttaaacgattgcgttcaaatatctaatccctccagcactctttatcataatgataaggaatcactgattttgagaaaagagaaaaagtgataaatgggctggcaataataatttttaggagtgattttaattctcatttggcacctgtgagttcattcacaaaaagccattaagtttcgagccgcctcacatttttttatatttcccgccaaacctggcaagagtggtgcgattgttgctctatccccctaaaccaccggatttctcaacaccggtcactcaatgatatctgtataagctaaggagagggttatgggggatattatgcgtcccattccgtttgaggaaattttgacgcgcatatttgatgaataccaacaacaacgctcaatctttggtattcccgagcaacagttttactcacccgtaaaaggtaaaactgttagcgtcttcggtgaaacctgtgccactcccgtcggccctgccgctggcccgcacacgcaacttgcgcaaaacatcgtcacctcctggctgactggcggacgcttcatcgaactaaaaaccgtccaaattcttgaccgcctggagctggaaaagccctgtatcgatgccgaagacgagtgctttaacaccgaatggtctaccgaatttaccctgcttaaagcctgggatgaatacctcaaagcctggtttgccctgcaccttctcgaagcgatgttccagccttctgattccggtaaatcgttcatctttaatatgagcgtcggttacaacctcgaaggtattaagcaaccgccgatgcagcagttcatcgacaatatgatggacgcatctgaccatccgaaattcgctcaataccgcgatgcacttaataagctactccaggatgaggcatttttagcccgccacggattacaggaaaaacgcgaaagcttacaggccttacccgctcgcatccccaccagtatggtgcagggcgtcaccctctccaccatgcacggctgtcctccgcatgaaattgaagccatttgccgctacatgctggaagaaaaaggactcaacacctttgtgaaacttaacccgaccttactggggtatgcgcgtgttcgtgagatcctcgatgtctgcggtttcagttacatcggcttaaaagaagagtcatttgatcacgacctcaagctgacgcaagcgctggaaatgctggaacgcctgatggcactggcaaaagaaaaatcactcggctttggcgtaaaactgactaacactctcggcaccattaataacaaaggcgcactgcctggtgaagagatgtatatgtcaggccgtgcgctgttcccgctctccatcaacgttgcagcagttctctctcgcgcctttgacggcaaactgcccatttcttattccggtggcgccagtcagctgactatccgcgatatttttgatactggtattcgccctattactatggcaaccgacctgctgaaacctggcggctatctgcgcttaagtgcctgcatgcgcgagctggaaggctcagatgcctggggacttgaccatgttgacgtcgaacgactgaacagactggcagcagacgcgctaaccatggaatacacccagaaacactggaagccagaagagcgtattgaagtggctgaagacctgccgctgaccgattgctacgttgccccctgtgttactgcctgcgctatcaagcaagatattccggaatacatccgtctgcttggcgaacaccgctatgccgacgcgctggaactcatctatcaacgcaacgccctgcccgccattaccggtcatatttgcgatcaccagtgccaatacaactgtacccgcctggattacgacagtgcgctgaatatccgcgaactgaaaaaagtcgcgctggaaaaaggttgggatgaatataagcaacgctggcacaaaccagccggttctggttcacgccatccggtagccgtgattggtgcaggtccggcgggtctggcagcaggttacttccttgccagagcgggccatccggttacgctgtttgaacgcgaagccaatgcgggcggcgtggtgaaaaatatcattcctcagttccgtattcctgcagagttaattcagcacgatatcgattttgttgccgatcacggcgtgaaatttgagtacggttgctcacccgatttgaccgttgaacagttaaaaaatcagggcttccactatgttctgattgccaccggtaccgataaaaatagcggtgtgaaactggcgggcgacaaccaaaatgtctggaaatcactccccttcctgcgtgaatacaacaagggcaccacactcaagctgggcaaacatgtggtcgttgtcggggcgggtaacaccgcaatggactgcgctcgtgcggcgttacgcgttccaggcgtagaaaaagcaacggtcgtttaccgtcgttcactgcaagagatgccagcatggcgcgaagagtatgaagaagcgttgcacgacggcgtggagttccgtttcctgaataatccggaacgtttcgatgctgatggcaccttaaccttgcgcgttatgtcgcttggcgaacctgatgagaaaggtcgtcgccgtccggttgaaaccaacgaaacagtaacactgcatgtagacagcctgatcaccgccattggtgaacagcaggatactgaagccctgaatgcgatgggcgtgccgctggacaaaaacggctggccagacgtcgaccataatggcgaaacgcgtctgagtgacgtctttatgatcggcgacgtacagcgcggaccatcctccattgtcgctgctgtcggaaccgcgcgtcgggcgaccgatgccatcctgagtcgggaaaatatccgttcccaccagaacgataaatactggaataacgtcaatccggcggaaatctatcaacgtaaaggcgatatctctgtcactctggtgaacagtgacgatcgtgatgcgtttgtcgcccaggaagccgcacgctgccttgaatgtaactacgtttgcagcaagtgtgtggatgtctgcccgaaccgcgccaacgtatccattgcggtccctggcttccagaaccgtttccagacactgcacctcgacgcttactgtaacgaatgcggcaactgcgctcagttctgtccgtggaacggtaaaccgtacaaagacaaaatcaccgtcttcagcctgtcgcaagactttgataacagcagcaaccctggcttccttgtggaagattgccgggtacgagtacgtctgaataaccaaagctgggtgttaaacatcgacagcgaaggtcagttcaacaacgtaccaccggagctgaacgatatgtgccgcattattagccatgtccaccagcatcatcattatctgctgggccgcgtggaggtgtaatcatgttgattctgaagaatgtcaccgcagtgcagttacacccggcgaaagtgcaggaaagcgttgatatcgccatcgaaaatgatgtgattgtcgctatcgacgatgccctgacgcaacgctatcccgatgccagctacaaagagatgcatggtcggattgtgatgccgggaattgtctgctcgcacaaccatttttactcggggctgtcccgcggaattatggcaaacatcgccccctgcccggatttcatctcaacgctgaaaaatctctggtggcggctcgatcgcgcccttgatgaagagtcgctctattacagcggactgatttgttccctggaagcaattaagagcggatgtacatcggttatcgatcaccatgcctctccagcctatatcggcgggtcgctctccacattgcgcgacgcatttttaaaagttggcctgcgcgcgatgacctgttttgaaactactgaccgtaacagcggcatcaaagagttgcaggaaggtgtagaagaaaacatccgcttcgcccgtcagattgatgaggcgaagaaagcagcaaccgagccgtatctggtggaagcacatatcggcgctcacgcgccgtttaccgtaccggatgccggtctggagatgctgcgtgaagccgtgaaaagcacaggtcgtggtttgcatattcacgctgcggaagacctttacgacgtttcctacagtcaccattggtacggcaaagacctgctggcacgactggcgcaattcgatctcatcggcagcaaaacgctggtcgctcatgggctgtacttgtcgaaagatgacatcgccctactcaatcagcgcgatgcgttcctggtgcataacgcccgttcaaacatgaacaaccatgtcggctacaaccatcaccttggcgacatccgcaatctggcgttgggaacggacggcattggttcggacatgtttgaagagatgaaatttgccttctttaaacatcgcgatgcgggtggcccgctgtggcctgacagttttgccaaagccctgactaacggtaacgaactgatgagccgcaactttggcgcgaaatttgggcttctggaagccggttacaaagccgatttaaccatttgcgattacaactcgccgacgccgctgctggcagacaatatcgccgggcatatcgctttcggtatgggctcaggcagcgttcacagcgtgatggtcaatggtgtgatggtctatgaagaccgtcagtttaacttcgattgcgattccatttatgcgcaagccagaaaagccgctgccagtatgtggcgtcggatggatgcgctggcataaataacagctcccctcttctttcagagaagaggggaaattaaggaaagacgatgattgaacaatttttcagacccgactctgtcgaacaggcgctggaactgaagcgccgctaccaggatgaagccgtctggttcgccgggggcagcaaactcaacgctacaccaacccgtaccgataaaaagattgccatttccttgcaggatctggagctggactggattgactgggataacggtgcactacgaattggcgcaatgtctcgcttgcagccactgcgtgatgcgcgatttattcctgcagcactgcgtgaagccctcggttttgtttactcacgccatgttcgtaatcagtcgaccattggtggtgaaatcgccgcccggcaagaagagtcagtgctgcttcccgtcctgctggcactggatgctgaactggtttttggcaacggcgaaacgctgtcaatcgaggactacctggcctgcccatgcgatcgcctgttaaccgaaattatcattaaagatccgtatcgcacctgtgcgactcgcaaaattagccgttctcaggcaggtttaaccgtcgtgacggcagccgttgcaataacagaccacgacggtatgcgaattgcgctggatggcgtcgccagtaaagcactgcgtctgcacgatgtcgaaactcaaaatctggaaggcaatgcacttgaacaggctgtcgccaacgccattttcccgcaggaagatttgcggggcagcgtggcctataaacgctatatcacgggagttctggtagccgatctgtatgccgactgccaacaggctggggaggaagccgtatgatcatccactttactttaaatggcgcgcctcaggagctaaccgttaatccaggcgaaaacgtgcaaaagctgttgtttaacatgggaatgcactctgtacgcaacagtgatgatggttttgggtttgccggttctgacgcaattatctttaacggtaatatcgttaacgcgtccttgcttatcgccgcacagttagagaaggcagatattcgtaccgcagaatctctgggcaaatggaatgagttaagtctggttcaacaggccatggttgatgttggcgtggtgcagtctggttataacgatccagctgcggctctgattatcaccgatcttctcgatcgcatcgacgcacctatccgcgaagagatcgacgacgcgctctcaggtctgtttagccgcgatgcaggctggcagcaatactatcaggtcattgaactggcggttgcacgtaaaaataatccgcaggccaccattgatatcgctccgactttccgtgacgaccttgaagtcattggcaagcattatcctaaaactgatgccgcgaaaatggtgcaggcgaaaccctgctatgttgaagatcgcgtaacggctgacgcctgcgtcattaaaatgttacgtagcccacacgctcacgcactgattactcatctggatgtcagcaaagctgaagccttaccgggcgtcgttcacgttattactcacctgaattgcccggatatttactataccccgggtggtcagagcgcaccggaaccatcaccgcttgaccgccgtatgttcggcaagaaaatgcgtcacgtcggcgatcgcgttgctgcggtagtagccgaaagtgaagacattgcgctcgaagcactgaagctcatcgacgttgaatatgaagtgcttaagccggtaatgtcgattgacgaggcaatggcggaagatgcgcctgtcgtgcacgatgaaccggtggtgtatgttgctggtgcgccagatactctggaagatgataacagccatgcagcccagcgcggcgagcatatgatcatcaacttcccgatcggttctcgcccacgcaaaaatatcgctgccagtattcatggtcatattggcgatatggacaaaggctttgccgatgccgatgtgatcattgagcgaacctataactcaacgcaggcgcagcagtgcccgactgaaacacatatctgctttacccgtatggacggcgatcgtctggtgatccacgcctccacccaggtaccatggcacttacgccgccaggtcgcgcgcctcgtgggcatgaaacaacataaagttcatgtcattaaagaacgtgtaggcggcggttttggctctaaacaggacatcctgctggaagaagtgtgcgcctgggcaacttgcgtgaccgggcgtccggtacttttccgctacacccgtgaagaagagtttattgctaacacctctcgtcacgtagcgaaagtcaccgtcaaactgggcgcgaaaaaagatggtcgcctgacggcagtgaagatggatttccgcgccaacacgggtccttacggtaaccactcactcaccgtaccgtgtaacggaccggcgctgtcgctgccgttatatccatgcgataacgtcgattttcaggtcaccacctactacagcaacatttgcccaaatggtgcttatcagggttatggcgcgccgaaaggtaacttcgctatcaccatggcgttagcggaactggcggaacaattgcagatcgaccaactggaaattattgaacgtaatcgtgtacacgaagggcaggagttgaaaattctcggtgcgattggtgaaggtaaagcgccgacatccgttccttccgccgccagctgcgcactggaagagatcctgcgtcagggtcgcgagatgatccaatggtcttcaccaaaaccgcaaaatggtgactggcacatcggtcgcggcgtcgccattatcatgcagaaatcgggtatcccggatatcgatcaggctaactgcatgatcaaactggaatcggatggcacctttatcgttcattctggcggtgcggatattggtactggcctggatactgtggtgacgaaactggcagcagaagtgctgcactgccccccgcaggacgtgcatgttatctccggtgataccgatcatgcgttgtttgataaaggcgcatatgcctcgtccggtacttgcttctcgggtaacgctgcgcgtttggcagcggaaaatctgcgggaggaaatcctgttccacggcgcgcaaatgttgggtgagccagtggcagatgttcaactagcaacgccgggcgtcgttcgcggcaagaaaggcgaagttagtttcggagagatagcccataaaggcgaaaccggcaccggctttggttcactggtgggaactggcagttatatcacgcctgatttcgccttcccgtatggcgcaaacttcgctgaagttgccgtcaacacgcgtacgggtgaaatccgcctggataaattctacgccttgctggactgcggtacaccggtcaatccagagttagcgttgggacaaatctacggtgccactctgcgagctatcggccacagtatgagcgaagagatcatttatgacgccgaaggtcacccgttaacgcgtgatttacgcagttacggcgcaccgaaaattggtgacattccgcgtgatttccgcgctgtgctggtgccgagcgacgataaagtcggcccattcggggcgaaatcgatctcggaaatcggtgtaaatggcgccgctccggcgattgctaccgcaattcacgatgcctgcggcatctggttacgcgaatggcatttcacaccggagaaaatactcaccgcgctggaaaaaatataagtaataaatggccgcttcggcggcctgtttctctgtttgaacgatgactaaatagtgactgcgaaaatgagataagccgttctcaaggcgtcctgcgccccaaattcgtgggaatttattttactaattcagatgatcaaatttactttaaaaggagtgaagggatgtctgatataaaccatgcaggttctgaccttatatttgaactggaggatcgccctccctttcatcaggctctcgtaggtgccattacccatctgttggcaattttcgttccgatggtaacccccgcgttaatcgtgggtgcggccttacagctttccgctgaaacaactgcctatcttgtttctatggcgatgatcgcctctggtattggtacctggttacaagtaaaccgctacggcatcgtcggttctggtttactttcaattcagtcagtcaatttttcatttgttacggtcatgattgcgctgggtagcagcatgaaaagcgacggttttcacgaagagttaatcatgtcgtcgctcctcggcgtctctttcgttggcgcatttctggttgtcggctcttcttttatcctgccctatttacgtcgggttattacgcctaccgtcagcggcattgtggtgctgatgatcggcttaagcctgattaaagttggcattattgattttggcggtggttttgcagctaaaagcagcggtacgttcggcaattacgagcatctcggcgttggcttattggttttgattgtggtgatcggctttaactgctgccgcagtccgttgctacgcatgggtgggatcgccattgggctatgtgtcggctatatcgcatcgttatgcctgggcatggtggatttcagcagtatgcgcaatttgccgttaatcaccatcccgcatccgttcaaatacggctttagttttagcttccatcagttcctggtggttggcacgatttatctgcttagcgtgctggaagctgtcggcgatatcaccgccacggcaatggtttcccgccgtcccattcagggggaagagtatcagtcccgactgaaaggcggcgtactggcagatggtctggtttctgttatcgcctccgctgtcggttcattaccattaaccacgtttgcgcaaaataatggggttattcagatgactggcgtcgcttcacgttatgtcgggcgaaccatcgcggtaatgctggttatcctcggcttatttccgatgattggcggcttcttcacgaccattccctcagcagttctgggaggcgcaatgacgttgatgttttccatgattgccatcgcagggattcgcatcatcatcaccaacggtttaaagcgccgtgaaacgcttattgtcgccacgtctttaggtttagggcttggtgtctcctacgatcccgaaatttttaaaatattgccagcctctatttatgtattagttgaaaaccctatttgtgctggcgggttaactgcgattttattaaatattatcctccctggtggctaccgacaggaaaacgttctgcctggtattacctcagcggaagagatggattaacagtaaaggagtcaatgatgtcaggagaacacacgttaaaagcggtacgaggcagttttattgatgtcacccgtacggtcgataacccggaagaaattgcctctgcgctgcggtttattgaggatggtttattactcattaaacagggaaaagtggaatggtttggcgaatgggaagacggaaagcatcaaattcctgacaccattcgcgtgcgcgactatcgcggcaaactgatagtaccgggctttgtcgatacacatatccattatccgcaaagtgaaatggtgggggcctatggtgaacaattgctggagtggttgaataaacacaccttccctactgaacgtcgttatgaggatttagagtacgcccgcgagatgtcggcgttcttcatcaagcagcttttacgtaacggaaccaccacggcgctggtgtttggcactgttcatccacaatccgttgatgcgctgtttgaagccgccagtcatatcaatatgcgtatgattgccggtaaggtgatgatggaccgcaacgcaccggattatctgctcgacactgccgaaagcagctatcaccaaagcaaagaactgattgaacgctggcacaaaaatggtcgtctgttgtatgcgattacgccacgcttcgcccctacctcatctcctgaacagatggcgatggcgcaacgcctgaaagaagaatatccggatacatgggtacatacccatctctgtgaaaacaaagatgaaattgcctgggtgaaatcgctttatcctgaccatgatggttatcttgatgtttaccatcagtacggcctgaccggtaaaaactgcgtctttgctcactgcgtccatctcgaagaaaaagagtgggatcgtctcagcgaaaccaaatccagcattgctttctgtccgacctccaacctttacctcggcagcggcttattcaacttgaaaaaagcatggcagaagaaagtcaaagtgggcatgggaacagatatcggtgccggaacaacttttaacatgctgcaaacgctgaacgaagcctacaaggtattgcaattacaaggctatcgcctctcggcatatgaagcgttttacctggccacgctcggcggtgcgaaatctctgggccttgacgatttgattggcaactttttacctggcaaagaggctgatttcgtggtgatggaacccactgccactccgctacagcagctgcgctatgacaactctgtttctttagtcgacaaattgttcgtgatgatgacgttgggcgatgaccgttcgatctaccgcacctacgttgatggtcgtctggtgtacgaacgcaactaataataaaactttaacatcctcgtgaggacatcattatgtctggagacatcctacaaacaccggacgcaccaaagccacagggcgcgctggataattattttaaaattaccgctcgtggcagtaccattcgtcaggaagtactggctggcttaacgacctttctggccatggtttattccgttatcgtcgttccgggaatgctgggcaaagcaggttttcctcccgcagctgtgtttgttgccacctgtctggtcgcgggcttcggctcgttgctgatggggttatgggccaatttgccaatggcgattggttgcgctatttccttgacggcgtttaccgcattcagtctggtactcgggcaacaaattagcgttcctgtcgcactgggcgcagtctttctgatgggcgtcatcttcaccgctatttccgtaaccggtgtgcgtacctggatcttacgtaatttgccgatggggatcgctcacggtacaggtatcggtatcggcctgtttctgctgctgattgctgctaacggtgtgggaatggttatcaaaaacccgattgaaggcttgccagtggcgctcggtgcgtttacctccttcccggtgatgatgagcttactggggctggcggtcatcttcggtctggaaaagtgccgcgtacccggcgggatcttgttggtgattattgcaatttcgatcatcggcttaatctttgacccagcggtgaagtaccacggtctggtggcaatgccaagcctgactggcgaagatggtaagcctttgattttcagcctcgatattatgggcgcactccagccaactgtacttccgagtgtactggcattggtgatgaccgcagtgttcgacgccactggcaccatccgtgccgtcgccggtcaggcgaatttgttggataaagacaaccagatcatcaacggcggcaaagccctgaccagtgactcagtaagttcaatattctccggcctggtgggcgcagcgcccgcggcggtttatatcgaatcagcggcaggaaccgccgccggggggaaaaccggtttaaccgcaaccgtggttggtgtgttgtttctgatgattctgtttttatcaccgttatcgtttctgatccccggttatgccacagctcccgcactgatgtacgtgggtttgctgatgttaagcaacgtctcgaagctggatttcaacgattttattgacgcaatggctggcctggtgtgtgccgtgttcatcgttctgacttgtaatatcgttaccggtattatgctgggctttgtaacactggtggtgggtcgcgtctttgcgcgcgaatggcaaaagctgaatattggtacggtgatcattactgccgcactggtcgcgttttacgcgggtggttgggcaatctaatagattctccgcgcctttccgcgcggagatttctttcagagaggattctcactgctggcagcaatacgctgctggcggatacgcctgagttctctttcagtaagcaactgcagcgcctgtgtcgggcaagattcaacgcaggctggcccctcttcccgcagttcacagagatcgcatttcacgatttgttgccggggatcacccggcaatgactgaatggtgatcatcccaaacgggcacgtgctaacgcaactctgacagccaatacaacgggcagaattggcctgcaccacctgctcgcccatcgtcagcgcccccacggggcaagcgccaacacaaggggcgttttcacactgatggcacatcaccggcgcactgatgctatccagccgttgtaccttcagccggggtaaaaagatatcggcattcaactcctgttctgaagggtgagcgaccacacaggccacttcacaagtacggcagccaatacagtcagccggattaacgataattaacgatttcatcacgatgccttcgtatcaaacagagttaacatatcgcgcgccgcctgccttcctgcggccattgcagtgacaaccagatccgcgccatgaactgcatcaccaccagcaaagacttttttcagatgcgtctgggtaggtaaatacccgacgtcgccggtttgaatcaggccccatttatcgagtttaattccgctgccctgcaaccacggcatggtatgtgcctggaaaccaaaggccataatgagaacatcggcgggcaattcaaactctgaacccgcaaccggacgaggacgacggcggccatccggccccggctcacccatagcggtacgaatcaggcccaccgccgttaagcgtccatcttcatcacaagcgatatattgcggctgaacattgaactgaaactcaacaccttcctcgcgggcattgaccacctctttgcgcgaacccggcatactgacttcatcacgacgatacgcacaggtcacgctggcagcattaaggcggatggaagtccgcaaacaatccattgtcgtatcgccaccgcccaataccacaactcgcttaccttccacatccgtcagcggatactctgcagactccggcaatcccatgagctggcgggtatgggcggtcaggaacggtaacgcctgaatgacaccaggcgcatcttcatgcggcagatctgctcgcatcatcccgtaagtccccacgccgaggaaaacagcatcatattccgccgttaattcgttgaaagagatatcgcggccaatttcacagttgagatggaaatcgattcccattgcggtgaatatctctcgccgctggcttaataccgttttatcgagtttgaaaggaggaatgccaaaagtcagcataccgccaatttctggatggcgatcaaagacatcaacctgaactcccgcgcgcgccagaatatcagcacaccctaatcctgcaggtccagcgccaatcaccgccactttttcgctacggggaacaactttgctgacatcgggacgccagcccatcgccagcgcagtatcggtgatgtagcgttccagattaccgatagagactgcgccagagtgatctttcaaagtacatgcgccttcacaaagacggtcctgtggacataccctgccgcagatttcgggtaaggaactggtctggtggcaaagttctgccgcttcaataatctttccttcctgtaccagacggatgtaatccggaatagcgttatgcagcgggcaatgccagttgcagttagctttttcggcacaataaacacagcggtcactctcataagtcgcttgttgtggatccagcccgcaatagatttcgccaaagtgggttttccgttcactcgctgaaattttatctgcgcctttacgcgagttaacggggagcaacgctgcactgcgagatggctgagcgcctgatgacgcttttcctgctgccgttttgcgctggcgggccacctttatctgctgcaaccctttatcgtccatcagccgtaacgcctgtgttgggcagacgtcaatacaggcttgcgtgccggaactgcgctggttacaaaggtcgcatttctgcgcaatcgtatcgaccatctcaacgacgccaaaggggcaagcgattgcgcatcttttacaaccaatacatttttgttcgttcagttgtacgctatcagcctgaaaagtcagagcataaaccggacaagccgtaacgcagggggcattgttgcaatgatggcaggccaccggattcgcagcctggcctttccctacaacgtggatacgcggtcgaaagtcactgtgactcagcggccagttttcttgattatgtgccaccgcacaggcaatttcacaagcatggcagcctatacattccgcagcttcagcagcgataaacttattcatttgcatccctttcatttaatgagttatgtcttctcaaatttcgcgatgcaataaacgggcatatattaggtagcatgaccgttttaattataattttgcaactgagttcaaattattgcccctcaatctatgccgctttcattatttcaacattgccgatcaaaagaatgctatccagataaaaacgattaaatgcgagagtgcgacatgccagaatgattaatgaaatatcaatatgagaaaattacagataattccattgtcaggttctcttctcataatcgtggtttaaccacgattatgtgattgcctccgcaattcctgtctctaactccccttcctcgcaaaaactggcactccacgagcatgtgtttagacagtttcatgaacataaacggttgctttttactctggcgggcgaaaggagaaacactgatgagcgccatagattcccaacttccctcatcttctgggcaagaccgcccaactgatgaggttgaccgcatattatcacctggaaagctgatcatactcggtctgcaacacgtccttgtcatgtacgcaggtgcagtcgctgttcctcttatgattggtgaccgactcggcctatcaaaagaagctattgcgatgctcatcagctcggatctcttttgctgcgggatcgtcacattattgcaatgtatcggtatcggccgctttatggggatccgcctgccggtgattatgtcggtgaccttcgccgctgtaacaccaatgatagctattggtatgaacccggatatcggcctgctggggatattcggtgccactatcgccgcgggttttatcaccacattattagcgccacttatcggtcgcttgatgcctttattcccgccactggttaccggtgtggttattacttctatcgggcttagcatcattcaggtgggtattgactgggccgccggaggtaaagggaatccgcaatatggtaatcccgtttatttaggtatctcctttgccgtcttaatttttatcttgctcattactcgctatgcgaaaggatttatgtccaacgtcgccgtattactggggattgtatttggctttttactttcgtggatgatgaatgaagtcaatttatccgggctacatgatgcttcatggtttgcgattgtcacgccgatgtcatttggtatgccgattttcgatcccgtttccattctgaccatgactgccgtgttaatcatcgtgtttatcgagtcgatggggatgttcctggcactgggtgaaatagtcggtcgtaaactctcttcacacgatattattcgcgggctgcgtgtcgatggtgtagggacaatgataggcggaacgtttaacagcttcccccacacgtcattttctcaaaacgttggcctggttagcgtgacgcgcgttcatagccgctgggtgtgcattgcttccggtatcattttgatcctgttcggcatggtgcccaaaatggcggtgctggtggcctccattccgcaatttgtgctgggcggcgcggggctggtgatgttcggcatggtactggcgacagggattcgaattctgtcgcgctgtaactacaccactaaccgttacaacctctatattgtggcgatcagtctcggtgttggcatgacgccaacgctctctcacgatttcttttctaagttaccggccgtactgcaaccgttgctgcatagcggcattatgctcgcaacccttagcgccgttgtgctgaacgtcttctttaatggctaccagcatcatgctgacctggtgaaggaatccgtctctgataaagatttaaaagtcaggacagtacgtatgtggcttctgatgcgcaagctgaagaaaaatgagcatggagaataatatgaatcttttaatgcgcgctatattcagtctgctgttgctttttactctctctattcctgtcatttctgattgtgttgcaatggccattgaaagtcgcttcaaatatatgatgctgcttttttaaatggtttttacctgtcgacatccgctcaaaacgggcggttgtcgataaacgctcacttggttaatcatttcactcttctattatctataatgatgagtgatcagaattacatgtgagaaattatgcaaacggaacacgtcattttattgaatgcacagggagttcccacgggtacgctggaaaagtatgccgcacacacggcagacaccctcttacatctcgcgttttccagttggctgtttaatgccaaagggcaattattagttacccgccgcgcccttagcaaaaaagcatggcctggcgtgtggactaactcggtttgtgggcacccacaactgggagaaagcaacgaagaggcggtgatccgccgttgccgttatgagcttggcgtagaaattacgcctcctgaatctatctatcctgactttcgctaccgcgccaccgatccgaatggcattgtggaaaatgaagtgtgtccggtatttgccgcacgcacgaccagtgcgttacagatcaacgatgatgaagtgatggattatcaatggtgtgatttagcagcggttttacgcggtattgatgctacgccgtgggcgttcagtccgtggatggtgatgcaggcgacaaatcgcgaagccagaaaacgattatctgcatttacccagcttaaataaaaaaccccgacggttgccggggttgtgagcataacgtaatgcttattttaccggacgcatcgccgggaacagaataacgtcgcggatggtatggctgttggtgaacagcattaccatacggtcgataccaattcccagacctgctgtcggcggtaagccatgttccagtgcggtgacataatcttcgtcgtagaacatcgcttcgtcgtcacctgcatctttcgcggcaacctgatccaggaagcgctgcgcctgatcttccgcgtcattcagctcgctaaagccgttaccgatttcacgccctccaatgaagaactcaaagcggtctgtgatttccgggttaacgtcgttacgacgcgccagaggagaaacttctgccggatattcagtaatgaaggtcggctggatcagatgagcttctgccacttcttcgaagatctcggtaacgatacggcccagaccccaactcttctcaacgtggatgccgatagattcagcaatcgctttcgcagagtcgaagttgtccagatccgccatgtcagtttccgggcgatatttcttgatcgcttcacgcatggtcagtttttcgaacggtttaccgaagtccagcgttacgtcgccgtaggtcacttccgtcttaccgagaatatcctgtgccagagtacggaacagcgattcggtcagctcgatcagatctttgtaatctgcgtaagccatatagagttccatcatggtgaactctgggttatgacgtacggaaataccttcgttacggaagttacggttgatttcgaatacacgctcgaagccaccgaccaccagacgcttgaggtacagttccggcgcgatacgcaggtacatgtcgagatccagcgcgttatggtgagtgataaacggacgcgcagcggcaccgccagggatcacctgcatcatcggcgtttcaacttccataaagccgcgattcaccatgaactggcgaataccagagaggatctgcgagcgcactttaaaggtgttgcgggattcatcgttagagatgagatccagataacgctgacgatagcgcgcttcctgatcctgcaagccgtggaatttatccggcagcggacgcagtgctttggtcagcagacgcagctcggtacagtggatagacagttcgccggttttggttttgaacagtttacctttcgcgccgaggatatcgccgaggtcccattttttgaactgctcgttgtaaacgccttccggcagatcgtcacgggcaacgtacaactgaatgcgaccgccaacgtcctgcagagtaacgaaagacgctttacccataatacgacgggtcatcatgcggccagcaacggcgacttcgatgttcagcgcttccagttcttcgttctctttaccgtcgaattctgcgtgcaattggtcagaggtatgatcgcgacggaaatcgttcgggaaggcaatcccctgctcacgcaggttcgccagcttctcacgacgcgttttcagttcattgttaagatcgactaccgcgtcagcgccctgtgcgtgttgttcagacatgttggttcctcataaccctgctttcaaacttgcttcgataaattgatccaggctgccgtccagcacggcctgcgtgttgcgggtttctaccccggtacgcagatctttaatgcgggagtcatcaaggacataagaacgaatctggctgccccagccgatgtcggatttattgtcttccatcgcctgtttctcggcatttttcttctgcatctccagttcataaagcttcgctttcatctgcttcatggcctggtctttgttcttgtgctgggaacggtcgttctggcattgggtcacgatcccggttgggatgtgagtaatacgcaccgcagattcggtacggttaacgtgctgaccgcccgcgccagatgcgcgataaacgtcgatgcgcagatccgccggattgatttcgatatcgatatcatcatcaacttccgggtaaacaaacgcggagctgaacgacgtgtggcgacgaccgccggagtcaaacgggctcttacgcaccaggcggtgaacgccggtttctgtacgcagccagccataagcgtaatcgccggagattttgatcgtcacggatttaatacccgccacttcaccttccgactcttcgatgatttcagttttgaaaccacgcgattcagcccagcgcagatacatacgctcaagcatgctcgcccagtcctgtgcttccgtaccgccagaccccgcctgaatatcgaggtagcagtcggcgctgtcatattcgccagagaacatacggcggaactcaagctgcgccagtttttcttccagggcgtcgagttcagcaacggcttcgttaaaggtttcttcgtcgtcagcttctacagccagttccagcagaccagaaacatcttccagcccctgtttcatttggtcgagggtgtcgacaacggcttcgagggaggaacgctctttacccagcgcctgtgcgcgttcgggttcgttccagacatccggctgttccagctcggcgtttacttcttccagacgctctttcttggcgtcgtagtcaaagataccccctaagaacgtcggagcgttccgtgaggtcctgaatgcgattatttaccggattaatttcaaacatggtctgatttcttttattgagctagtcaaaatgcggtgataagagcgggattgtacccaatccacgctcttttttatagagaagatgacgctaaattggccagatattgtcgatgataatttgcaggctgcggttgccgcgaaactcgttgatatcgagcttgtaagccagttgcacttcgcgcacaccgttatccggccagagggcggtatcgacattaaaagcaatcccgtccagcagtggaccgccgccgaccggttcgaccatcaccttcaaatgacgctcgcccaccagccgctgttgcaacagacggaaatgaccgtcaaacaacggttccgggaacatctgcccccacgggccagcatcacgcaacagctgcgccacttccatggtcatctctgccgcacttaatgggccgtctgataccacttccccttgcaataaagaaggatctaaccactcggtaaccagttcgccaaagcgttgctgaaagagttcgaatttatcctcttccagcgacaatcctgccgccatcgcatggccgccaaacttgagcatcatgccggggtaaagcgtgtctagccgctccagcgcatcgcgcatatgcagcccctgaatggagcgaccggaacctttcagcgtaccgtcgcccgcaggcgcaaaggcgataaccggacggtgaaaacgctctttgatacgcgatgccagaatgccaacaacgccctgatgccattcagggtgatacattgccagcccacctggcagcgtgtcgcggctacgttccagcttctcgcacagagtgagcgcttcaacctgcattccctgttcgatctctttacgtgtttggtttagtgcatcgagttcattcgccagcacacgcgcttcgccaatgttgtcacacaacaacagcgccacgccaacggacatatcgtccagtcgcccggcagcattgagacgtggccccagcgcaaaacctaaatcgctggcggcgagtttttgtggatcgcgattggccacttccagcagcgctttaatccccggacggcactttccggcacggatgcgactcatcccctgccaggtcagaatgcgattattagcgtccagcggcacgacgtccgccactgtccccaacgctaccagatccagcagttctgccagattaggaattgcgatgccgcgctcatcaaaccagccctgatcgcgcaaaaaggtgcgcagcgccagcatcagataaaacgccacacccacgcctgccagtgatttcgacgggaaattacagtcgcgcaagttagggttaatgatcgcttccgctgcgggtaatgtgtcgcctggcaaatggtgatcggtaacaataaccggaatgcccaacgaacgagcgtgttcaacccccgcatgggaggaaataccgttatccaccgtgacaattaactgcgcgccacgggcatgagcctgatcgactacttccgggcttaagccgtaaccgtcttcgaaacggtttggaaccaggtagtcgatattgctgcaaccaagcgagcgcatcgccagcacgcttagagccgtgctggtcgcaccgtcggcgtcgaaatcaccgaccacaataatccgcgttccttcgcgaaaagcgttgtaaaggatctcaacggccttttcgacgccgctcagttgctgccagggcagcatgcctttaacactgcgttccagttcctgcgcgctacgcacaccccggctggcatataaacggcgcagcaagggaggcaattcagcgggcaagtcggccgtttcatcgacttctcggcgacgaagttgtatctgttgtttcacgcgaattatttaccgctggtcattttttggtgttcgtcgaggaattctttcatgtctttcggcggctggtaacccggaacaagtgtgccattgctcagcacaactgccggagtaccgctaacgccaagctggacgccaagtgcgtaatggtcggcaatatccacgtcgcagctggctggtgcgacgcttttacctgccatcacatcatcaaacgctttgtttttatctttcgcacaccagatagctttcatttctttctctgcatcgctgtccagcccctggcgcgggaaagcaagataacgcacggtgatccccagcgcgttatagtctgccatttgctcatgcagtttgtggcagtaaccacaggtaatatcagtaaacacggtgatgacgtgtttttcctgcggcgctttataaacgatcatctctttttcaagcgcattcaactgctttaacagcatcttattggtgacattgaccggagccgtgccactaacgtcatacattggcccctgaatgatatgtttaccatcatcggtgatgtacaacacaccgctgttagtcagaactgtcttcatgccagctacgggcgcgggctgaatatcgctgcttttgatgcccattttggctaacgtttgttgaattgccgcgtcatcagcctgaacaaagcctgaaaacgctgccaacaaggtaaataacataaaacctttcttcataaattttcctgttcttttcagacatcacgcccgcgggtgatgctgttgatgaagttgccgcagacgctcggtagcgacatgcgtataaatttgcgtggtggagagatcgctgtggcccagtagcatctgcaccacgcgcaaatccgcaccatgatttaataagtgagtggcaaaagcgtgacgcaacacatgcggtgacagcttttcgctgtcgatacccgccagcacggcataatgtttaatgcggtgccagaaggtctgtcgcgtcatctgctgcgcacgctggctgggaaacaacacgtcaattgacacaccattcaacagccacggacgcccatgttccagataggtttccagccagtaaaccgcctcttcacctaacggcaccaggcgctctttgttgcctttaccaatgacccgcaccacgccctgacgcaggctgatatcactcattgtcagcccgaccagttcagagacacgcagtccggtagcatacaacacttcaagcatggctttatcgcgtagctccagtggctgatcaattaatggtgcctgtaataaacgttcgacctgcgcttcgcttaaatcttttggcaaacgctggggcaatttcggtgaagcgagatgcgcactgggatcatcttcacgaaacttttcgcgataaagatactggaacaatcggcgcactgcactcagcaaacgcgctgagctggtggctttatacccgccctccagccgttctgccagtaatgcctgcaaatcgtcactttgcgccgtcgccagcgtcaacccgcggtgatgcaaccactccaccatcattgacagatcgcgacggtaagcgttcaacgtattttcagccagatttttttccagccacagagcatcaagaaactgctcgatgcgtgccagatcctgtttcacttgcgccccttatggtcactcatttgatccattatgccttattgtgccgtgactaaagcgattctgatacactagccgcaaaagccacagcagaatcgagaagcttacgttatgaatatgggtcttttttacggttccagcacctgttacaccgaaatggcggcagaaaaaatccgcgatattatcggcccagaactggtgaccttacataacctcaaggacgactccccgaaattaatggagcagtacgatgtgctcattctgggtatcccgacctgggattttggcgaaatccaggaagactgggaagccgtctgggatcagctcgacgacctgaacctcgaaggtaaaattgttgcgctgtatgggcttggcgatcaactgggatacggcgagtggttcctcgatgcgctcggtatgctgcatgacaaactctcgaccaaaggcgtgaagttcgtcggctactggccaacggaaggatatgaatttaccagcccgaaaccggtgattgctgacgggcaactgttcgtgggtctggcgctggatgaaactaaccagtatgaccttagcgacgagcgtattcagagctggtgcgagcaaatcctcaacgaaatggcagagcattacgcctgatgtcactgacggcttagcacatatgctttgccgtcatctttatctttgcgtctcttgttgtaacaatatccgccgtaaatcccgccattcggcttcgtccatgctgtcagctgccagccataaatgttgccgttttccgctgtcagaacgtaaacgcagcatcatgccgctcttaatcatccacggcgctttgacgatgctccactcctgcccttgccaacgcaaacgcccgtccatcaacaagcgaatttccccctggcgagcattaatgcgccgctggctgcgaacgcaatcaaacaccaccagcgaaagtaacaccatccataacggggtgtaactgagcggccagggcatgagtaaaataacagcggcaaccagcccatgaatcagcaaggaaagccactgtgcgcgccaggagacgcgcaaatcagattgccacaggaccacgttcccggttccgtgtctggatgagtcggaccatcatttccagttctgcatcggctggtttaccgtgattcatcagccagttaaacaggtccggatcgtcacattccagcagacgaataaagatgcgtttttcgtcatcgcttaagctgtcgtactcatgttcgaaaaacggcatgattgaaatatcgagttcgcgcataccacggcggcatgcccaatgaatgcgggctttgttgttaatgtccatcttcttcctgtctcacgaaaatccagtacccggctattgtaacgtgtttttcgacttcttttacgggaatatcagtaaacacaatcgcgatcgcgaaattaattcacaacaattcaagggcttcatttttttggaagtcgcctcgcagaaggcacagatcgcgtagtgaaagcacttgcattgcctcatagctcttttaccattagttattaatacgccgttaagcaactcaggactctattatggcttttacaccttttcctccccgtcagcctacggcttctgcccgtttgccactgacgctgatgacgcttgatgactgggcgcttgccactattactggcgcggacagcgaaaaatatatgcaaggccaggtgacagcagatgtcagccagatgacagaagatcagcacctgctcgccgcccattgcgacgccaaaggtaaaatgtggagcaatttacgtctgttccgcgacggcgatggctttgcatggattgaacggcgcagcgtgcgtgaaccacagctgactgaactgaaaaaatatgcggtgttctctaaagtgaccatcgcgccagacgacgagcgtgtgctgcttggtgttgccggttttcaggcgcgcgccgcgttggcaaatctctttagtgaactaccttcgagagaaaaacaggtagtcaaagaaggcgcgaccacgttgctatggtttgaacacccggcagaacgtttcctgatcgtaaccgatgaagctactgccaatatgctgaccgataaactgcgcggtgaagcggaactgaacaatagccaacagtggctggcattaaacattgaagcgggttttccggtgattgatgccgccaacagcgggcagtttatcccccaggcgaccaacctccaggcgctgggcggtatcagctttaagaaaggctgctataccggacaagagatggtggcgcgagcaaaattccgtggtgccaacaaacgcgcgctctggttgctgaagggtagcgccagccgactgccggaagctggtgaagacttagagctgaaaatgggcgagaactggcgtcgtaccggtacggtgctggctgcggtcaaactggaagatggtcaggttgtggtgcaggttgtcatgaataacgatatggaaccggacagcatcttccgcgtgcgtgacgatgcgaatacattgcgtatcgagccactgccatattcgctggaagagtaaatctctgtatcgcatcaggcatttatcgcctgatgcgacactggtgtgtcttttcaggcctacaaaggcatacccattacgcctgcccaatatacaaatagatcgccagaaagtggcacacactaccgccgagcacaaagccgtgccagatggcatgattgtatggaatgcgcttgcagacgtagaaaatcaccccgagcgaataaaccacaccgcctaccgccagtaaggtaacgctgcccgccgcgagcttaactgccatttcataaatcaccaccagcgacaaccagcccatcgccagataggtcaccagagataaaattttgaatcggtgcgcgatggtcagtttaaacagaatacccagcaatgccaggctccagataacaatcatcaacccgcgcgctaacggagaatccagccccaccagcaaaaacggcgtataggttccggcaatcaacagataaatggcacagtggtcaaatttcttcagccacatttttgcccgttgatggggaatggcgtgatagagcgtcgaagcgaggaacagcaggatcatactgccgccatagaggctgtaactggttatcgccgtggcgctggcattgagatccaccgcctgaaccagtagcaacaccagcccaacgataccaaacaccagcccaatgccgtgactgacactgttggcaatttcctctgccagcgaatatccctgcttaatgaggggcttctgaaccataacttactccggaaaaacgtacacgcacatgtatacctctccagcgtaactgagaatagttccagtgaacacctgttagctaaaataaattctgatttgagattaatctccgaaaaatcatgaaattaaatgcgaaatttcaactaacaggcgtgagttcaatttaaagacatttaaattcaatcacataaaactgtgtctggtcgggatagatgtcggcaatgacctttttcagttcagtcagggtcatattttcctgctctgcatgtttttccgtcagcgtatccagcgttacggttgaggttgcggtgacttcaatcgtgcaaaaataaccgtcatcttcaaaacgtccgacacgaagcacatcacccgttttgaagtgcgattcagactcgtcgcggatggtgatggttttacgcccagccagaatgtcatcctggaaacgttgaaaaaaagtgatgtcgtttggctgcatggtactatttcctgtaagaattgactcatctggagcctatgatagtgaaaaaactcaccttaccgaaagatttcttatggggcggcgcagttgccgctcatcaggtcgaaggcggctggaacaaaggcggcaaagggccgagcatttgtgacgttctgaccggtggcgcacacggcgtgccgcgcgaaatcaccaaagaagttgtgcctggcaaatactatccaaaccatgaagccgttgatttttatggtcactacaaggaggacatcaagctatttgccgaaatgggcttcaaatgttttcgtacttccatcgcctggacgcgcatttttccaaaaggcgatgaagctcagccaaacgaagaagggctgaagttctacgatgatatgatcgatgaactgctgaaatacaacatcgaaccggtgatcaccctctcccactttgaaatgccgctgcatctggtgcagcaatatggtagctggaccaaccgtaaagtggttgatttctttgtccgtttcgcggaagtggtatttgaacgctataagcataaagtcaaatactggatgaccttcaacgaaattaacaaccagcgtaactggcgtgcaccgctgttcggttactgctgctccggcgtggtgtataccgagcatgaaaacccggaagagacgatgtatcaggtgctgcatcaccagtttgtcgccagcgccctggcggtgaaagccgtgcatcgcatcaacccggagatgaaagtcggttgtatgctggcgatggtgccgctctatccttactcctgtaacccggacgatgtgatgtttgcccaggagtcgatgcgcgaacgttacgtctttaccgatgtgcagttgcgtggctattacccgtcctatgtgttgaacgagtgggaacgccgcggatttaacatcaaaatggaagacggcgatctggatgtactgcgcgaaggcacctgcgattatctcggcttcagctattacatgaccaacgcggtgaaggccgaaggcggcaccggcgatgcgatctctggttttgaaggcagcgtaccgaacccgtatgttaaagcgtctgactggggctggcagattgatccggttggtctgcgttacgcgctttgcgagctgtatgagcgttaccagaagccgctgtttattgtcgaaaacggttttggcgcttacgacaaagtggaagatgatggcagcatcaatgacgattaccgcattgactacctgcgcgcccatattgaagagatgaaaaaagcggtgacttacgatggcgtggacctgatgggctacacgccgtggggctgcatcgactgtgtgtcgttcaccaccgggcagtacagcaaacgctacggctttatctatgtgaataaacatgacgacggtactggcgatatgtcgcgttcacgtaagaagagctttgactggtacaaagaggtgattgccagcaacggcgagaatctgtaattagccgatgtgcctgatgtgctccgctcatcaggcctggcactcttttaatatattgagctcgcaatattttatattacgcctcagccgaaacacacaaagcgcactttattaacaagcgaaaaaggcgccgaagcgcctttataagatagtcaaatcagtaaattactggtattcgctaatcggtacgcaggagcagaacaggttacggtcgccgtaaacatcatccagacgtttcacggtcggccagtatttgtctgccacacctgccgggaatactgcaacttcacggctgtacggatgcgcccactcggcgaccagttcgctctgaatgtgcggcgcgttcaccagcgggttatcttccagcggccagacaccggctttcacctggtcaatttctgcgcggatagccagcatcgcatcgataaagcgatccagttccactttgctttcagattcagtcggttcaaccatcagcgtacccgccaccgggaacgacatggtcggcgcgtggaaaccgtagtcgatcaggcgcttggcaatatccagttcgctgatgccggtttcttctttcagcgggcgaatatcgagaatacattcgtgcgccacgcgaccgtcgcgaccggtatacagcacagggaaggcatcctgcagacggctggcaatatagttggcgttaagaattgccacctggcttgcttttttcagcccttctgcgcccatcatgcggatgtacatccagctgattggcaggatagaggcactaccgaacggtgccgcagaaaccgcgccctgacgggttaacatgccttcgatttgcaccacgctatgacccggtacaaacggagccagatgcgcttttacaccgatcggtcccatacccggaccaccaccgccatgcggaatgcagaaagttttatgcaggttaaggtgggaaacgtccgcaccaataaagcccggcgaggtgatgccaacctgagcgttcatgttcgcgccatcaaggtaaacctgaccgccgaactgatgcacgacttcacacacttcacggatcgtttcttcatacacgccgtgggtagaaggataggtcaccatgatacaggagaggttatcgcccgcctgttccgctttcgcgcgcagatcagtcagatcgatgttgccgtttttatcacacgccacaaccaccacctgcattcctgccatatgcgcggaagccgggttagtgccgtgcgcagaagccgggatcaggcagatatcgcgatgcccttcgttgcggctttcatgataatgacgaatcgccagcaggcccgcgtattcgccctgtgcgccagagttcggctgcatacaaacggcgtcgtaaccggtcagtttcaccagccagtcagccagctgcgcgatcatctgctgataaccttcagcctgttccggcgggcagaacgggtgcagttcggcaaattccggccaggtgatcgggatcatctcggcggcggcgttcagtttcatggtgcaggaacccagcgggatcatcgcctgattcagcgccagatctttacgctccagcgagtgcatatagcgcatcatttcggtttcgctgtggtagcgattaaacaccggatgggtgaggatttcgtcgtcgcgcagcatcgcagcctgaatagagcgactgtcgtgagccacgtctttgtccagtgtgtcgatgtccagcccgtggttatcgcccaacagcacgctgaaaagctgcatcacgttttcgcgcgtggttgtttcatcaagggtgatcccaaccgcgttcagaatatcgctacgcaggttgatttcagccgcttcggcacgcgccagcacgcccgctttgtcggccacttccacacacaaagtatcgaaatagtgcgcatggcgcagcttcagacctttttgttgcaggcccgccgccaggatatcggtcagacggtggatgcggttagcgatacgtttcaggccaaccggaccgtggtaaacggcatacagactggcaatgtttgccagcagtacctgggaagtacaaatgttggagttcgctttctcacgacgaatatgttgctcgcgagtctgcatcgccatgcgcagagcggtgttgccagctgcatctttcgatacaccgataatacggcccggcattgagcgtttgtattcgtctttcgccgcaaagaatgccgcgtgtgggccaccatagcccatcggtacgccaaagcgttgcgccgaaccaaaaacaatatccgcgccctgtttacccggcgcagttaacagcaccagcgccataatatcggcggcaacgctgaccacaattttgcgtgatttcagttcgctaataagcgcggtgtagtcgtgaatttcaccagtagtgccgacctgctgtaacagcacgccgaaaacgtcctgatggtcgagcactttttgcgcgtcatcgacaatcacttcaaaaccaaaggtttcggcacgagtacggaccacatccagcgtttgcggatgaacgtcagaagcaacaaagaagcggttggcatttttcagtttgctgacgcgtttcgccatcgccattgcttcggcggcagcggtggcttcgtcaagaagagaagcagaggccatatccagcccggttaaatccagcgttacctgctggaagttgagcagtgcttcaaggcggccctgggagacttcaggttgatacggagtatacgcggtataccagcccggattttccagcatgttacgcaggataaccggcggtagctgcacggcggtgtaacccatgccgatgtaagacgtgaagcgtttattgcgactggcaatagccttgagttctgccagtgcggcgtattcggtcgccggtgcgccaacctgcggcggagtcgcaagctgaatatctttcggcacaatctggccggtcagcgcgtttaacgattgtgcgccaacggcattcagcatttcttgctgttgcgcggcgtccggtccgatatggcgttcaataaaagcgccgctgttttcaagctggcttaacgtctgtgtcatgagcgatggttcctgaaacgtgcagtgaattgtgaacctctctccttgcgaagagagtgagggtgaggcgtaaatttcctcaccctgatcctctcccgcagaagaggaataaagccgttactcgtcttctaacaatgcttcgtatgcggttgcatccagcagtgattccagttcgctttcatcgctggctttgattttgaaaatccagccgcctgcatacggttcgctgttcaccagttccggggaatcgctcagtgcatcgtttaccgccacgatttcaccgcttactggcgcataaatgtctgacgccgcttttaccgattcggcaaccgcgcagtcatcgcccgcgctaaccgttgcgcccacttccggtaggtcaacaaacaccatatcgcctaacagctcctgagcgtgttcggtgatgccaacggtgtaagtgccgtcggcttctttacgcaaccattcgtgttctttgctgtatttcagttctgctggtatgttgctcatcaatcaatctccaaaaaagtaaatcacgcgacggctttgccgttacgcacaaaaacaggtttcgtcactttaaccggcatttcacggttgcgaatttgcacaatcgccgtttcaccaataccttccggcacgcgcgccagcgcaatgctataacccagcgttggggagaaagtaccgctggtgataatgccttcatgctggttgccctgcgcatcagtaaaacgtaccggcagttcattacgcagcacgcctttttcggtcatcaccagaccaaccagtttttctgtgccatgttcacgctgcgcttccagagcttcacgaccgataaagtcacgatctgccggttcccaggcgatagtccagcccatattggcggctaaaggagaaatagtttcgtccatctcctggctatacaaattcatgcccgcttccagacgcagcgtgtcacgcgcgcccaggccacatggcttaacgccagcttccaccagcgcgcgccagaaatcggccgctttttcattgggcagcgcaatttcgtagcccacttcaccggtgtaaccggtggtggcaataaacagatcgcccgcctgcacgccaaagaacggtttcatcccttccaccgcctgacgctgggcgtcattaaacagtgtggcagcttttgcctgcgcattcggcccttgtacggcgatcatggaaaggtcatcacgaacagtaatttcgatgccgaaaggttcagcgtgttgggtaatccaggagaggtctttttcgcgggtggcggagttaacaacgaggcggaagaaatcttcagtaaagtagtagacgatgagatcatctatcacaccgccagaggcattcaacatccccgagtaaagggctttgccgcttttggtgagcttcgccacatcgttcgccagcagataacgtagaaactcccgggtgcggctgccgcgaagatcgacgatggtcatatgtgacacatcaaacattccggcatcggtacgtaccgcatgatgttcgtcgatttgcgaaccgtaatgcagcggcatcatccagccgtggaaatccaccatgcgagcgccgcaaagcgtgtgttgttcgtacaaaggagtctgttgtgccatcttgtcctcattgaataagcggggctgacaacttttccatggcgaaattatcaccacgaaacccagcatcggagccactcccggtccccaacgcaatcgttctcttttgcctgaacttaccaccgaaacagactgttaaccataaggtaaaattgatcatcacattagcttatggttaaaaaatgcaaaaatcgcaacagaataaaaaaccaaaaaacacgcctttttctataaaaagatgatgtgatgagaaagttaatttgaataagacaatattaagcgctaaaaaaatgtcaaaaaacactaaatcaaaaaaccataacattagaaaatataatgcgaaaacggaggttaaattagtttatttcaaatgaggaaaatcccccggcgaaaaaaccgggagatgaaagtgtgatgggtatcaaataaacagcagaagagaaatatttaacgcagccattcaggtaaatcgtttaatcccattgcctgacgaataagttgtggcttaacgccaggaagcgtatcagccagtttcagaccaatatcacgcagcaattttttcgccggattagccccggaaaacagatcgcggaatccctgcataccagccagcatcagcgccgcgctgtgcttgcggctacgctcatagcgacgcaggtaaatgtactgcccgatgtctttaccctgacgatgcaaccgtttcagttcagcaatcagctctgcagcatccataaagccgagatttaccccctgccccgccagcgggtgaatagtatgcgcagcgtcgcccaccagcgccagacggtgtgcggcaaactggcgcgcataacgccccgtcagcgggaacacctgacgctcgctctcaaccttgcataagcccaggcgattatcaaaagcaatatttaacgcgcgattaaattcgtcttcactagcctgctgcatccgctgcgcttcctctggcgacaatgaccagacaatcgagcaaagatgcggatcgctaagcggtaaaaaggccagaatgccttcgccatggaaaacctgccgcgccaccgcatcatgcggttcttccgtgcgaatggtcgccaccagcgcgtgatgctgataatcccagaaagtcagcggaatatcggctttgttgcgcaaccaggaattagcgccgtccgcgccaatcaccagacgcgccgttaacatgctgccatctttcaacgtcaggaaggtttcattttctccccaggcgacctgctgtaattctgcgggggccaacagagtgatatctgacgactgctgcgctttgttccacagcgcgtagtgaatcactgagttttcaacgatatgcccaagatggttatagcccatgctttgatcgtcaaacgagatgtgaccaaaactgtctttgtcccacacttccataccgtgatagcaactggccctacgagagagaatgtcctgccagacgccaagacgagtcagtaatttttcgctggcggcattgatagccgaaacgcgcagttgtggtggtgcatccgccgccagaggttccggtacgcgctgctccagtacggcaacgcgtaagccgctcccctgtaagccgcaggcaaccgccagccccaccatgccgccaccaacaatggctacatcaacactttgcattgtttattccttaaaaccgccttcaacgcgccacccaaccgagggtgcgctgcgccagcacatcgcgtgccggggtaaataattccatcgtcatcagcccgatgttgcgcccgacaaccagcggggtccaacggttggcaaaaagatgtacaaggctgtccgtgacgccgatggttgcttcgcgatcgctctgtcgacgctgctgataacggcacaatacgccgtaatcacccatgtcttctccgcgctcctgcgcctgagtcagggtttctgcaaggctcatgacatcacgcataccgaggttgaacccttgcccggcaatcgggtgcagagtttgcgccgcattgcccaccagcacggtacgatgggtaataggtctggcggcgcgggttaacgccagcgggtaagcactgcgtttaccggcgtgggtaatttgccccagtcgccagccaaaggcagactggagctcacggcaaaacttctcgtcactccacgacagcagctcttcgcgccgttccagtggatgacaccagactagcgaacagcgtccgtcagacatcggcaacatcgccagcgggccatgttgcgtaaaacgttcaaaagcgcggccttcgtgcgcaacggaagtcgcaacgttggcaatcacggccagttgttcgtaaggctcctgctgccagtcaacgccgcacacagtggctaacgctgaatgggtgccatcagcggctaccagcacgcagcccgtcagcatctcgccgctctccagcgtcacttcaacgtgactctgagtacggcaaacgttagcaacacgatcagggcaatgcagcgttacgccaggtgctttgcgcagcaatgcaaacagccgttgcccgacattgtgcaactcaacaacctgccccagcgccgccagttggtaatcttctgcggcgagggtgacaaatccagcgtgaccacgatcgctgacatgcacggtggtgatggcagttgcgcaatcagccagagattgccagacgccgatgcgcgccagttgctgacaggtacccgccgccagcgcaatagctcgtccatcaaagcccggatgcgcatgtgactctggcgcggtcgcttcaatcaaatgtactggcagcgccccgtgacttaaccgggaaatagccagcgccagcgtcgcgcccgccatgccgccaccgacgatgattacgctcattgctttctcgcagctgccatcaacgcttcgatttcttccggctttttcaccacgctggcggtgaggttttcattaccggtttcggtaatcacaatatcgtcttcaatacgaatgccgataccgcgatactgttctggcacttctgcatccggcgcaatatacagccctggttctacggtcagtaccatacccggttccagaatacgcgagcgatcctgaccataaacaccaacgtcatgaacatccagtcctaaccagtggctaaggccatgcataaagaaaggacgatgggcgttctgagcgatcagttcatcaacatcacctttcaggatgccgagttttaccagaccgctaaccatgatgcgcaccacttcaccagtgacttcctgaatggaagttcccggacgatacaggcacaggctggtttcaagagactccagcacaatgtcatagatttcacgctgagcctgagtgaatttgccgttgaccgggaaggtgcgggtaatatcgccagcgtaacctttgtattcgcaaccagcatcaatcaacaccaggtcaccgtcacgcagttcacactcgttttcggtgtagtgcagaatgcagccgttttcaccgctgccgacaatggtgttataggaaggatagcgcgcaccgtggcggttaaattcgtggtgaatttcgccttccagatggtactcgaacattcccggacggcatttttccatcgcccgtgtatgtgccagggcggtgatttctcccgcgcggcggagtacggcaatctcttctggcgatttgaacaggcgcatttcatggaccatgggacgccagtcgatcatcgttgctggcgcggtgagattttgtcgcgaacctttacgcagtttttccagtgcactgttcacgatttcatcagcatatgcatattcgccctgagcatggtaaaccacatccaggccgttaagtagttgataaagttgctgattgatttcactaaatgccagtgcgcggtcaacgcccagtttctctggcgcggcatcctggcctaagcgacgaccaaaccagatctctgccgtcagatcgcgcacgcggttaaacagaacgctgtggttatgagtgtcatcgcttttaatcagcaccagcaccgcttccggttcgttaaagccggtgaagtaccagaagtcactgttctgacgataggggtattcgctgtcggcgctacgtgttacttctggtgcagcaaaaatcagcgcggcgctgccgggttgcatttgctccaccagggcctgacggcgacgctgaaactcttgccgggatatctcactcataacactctccttacattttttgtttttagtgtagagtcggtttttgtacttctggcgcggtcggttgcggatgagtaaaggtgtcgtggcataacagcgcggcaacacgaacgtattcgatgatctcttcaagcgacatttcaagctcttcctgatcttcgtcttcgtcgtaacccaactgcgcgatgttacgcagatcgtcgatggcttcaccggtttcgccggtcactttgtccagcttcggttgcgtaacgccaagaccaagcaggaagtgattgacccaaccagccagcgcatcagcccgatcgaaaacgctgacatcatcgccatcaggcagataaagctgaaaaaggaagccgtcatcctgcagggcatcgctggtggcagagtgcattttgcgcagtgcctgtgccagctcatgaccgaaagccatgccttcgttcgtcaggtcgtgaagtagcggcagccatgagctgtcatcgttaccgccacatatcatcccactgattaaaccatgcatctcagcaggggtcagacccgtcccttgttggttcagatactggttcatttcgttgtaaccaggcatttcgttctgtatagacataagcattcgtcgtcaaagggaggaatattcatgatatgctaccactttgggccctggtggaccagaaaagggcttgtctcttctcatcagggtagctatagtgtcgccccttcgcagaccatgggtctaaagacgaaggcagcgcagtcaatcagcaggaaggtggcatgtctgcacaacccgtcgatatccaaatttttggccgttcactgcgtgtgaactgcccgcctgaccaaagggatgcgttgaatcaggcagcggacgatctgaaccaacggttgcaagatctgaaagaacgcactagagtcacaaatactgaacagttggtcttcattgccgcattgaatatcagctatgagttagcgcaagaaaaagcgaagactcgtgactacgcggcaagtatggaacagcgtattcggatgctgcagcagaccatagaacaagcgttacttgaacaaggtcgcatcaccgaaaaaactaaccaaaactttgaatgacacttttcggtttactgtggtagagtaaccgtgaagacaaaatttctctgagatgttcgcaagcgggccagtcccctgagccgatatttcataccacaagaatgtggcgctccgcggttggtgagcatgctcggtccgtccgagaagccttaaaactgcaacgacacattcaccttgaaccaagggttcaagggttacagcctgcggcggcatctcggagattcccttcttatctggcaccagccatgacgcaactaccagaactcccactgacattatcccgacaagaaatccgcaaaatgattcggcaacgtcgtcgtgcgttaacgccggaacaacagcaggaaatgggtcaacaagccgctacccggatgatgacttatcccccggtggtgatggcacatacggtcgctatattcctctcttttgatggcgaagtcgacacccagccactcatagaacaactctggcgcgccggtaagcgcgtatatcttccagttttgcatccctttagtgccggtaatttgctgttcctgaactaccatccgcaaagcgaactggtgatgaacaggttgaaggtccatgagccaaaactggatgtgcgtgacgtgctacccctttcccgattagacgtgctgatcacaccgctggtcgcctttgatgagtacggtcagcgcctgggaatgggcggtggtttttatgatcggaccttacaaaactggcagcactataaaatgcaaccggtgggttatgcgcatgattgtcagttggtggaaaaactccccgttgaagagtgggatatccctcttcctgcggtggttacaccgtcgaaagtctgggagtggtgagggcgacacacctgcatcgccctgattgacatcgttgattctttaacctaatttagtgagtaagggtaagggaggatgactcctcccctgagactgactgttaataagctgggaaacttatgagtaacagtacaatcagtatgatgacaagtcgcatcataacccttctccttcaagccctcgcttcggtgagggctttaccgttacagccccatgctgccctgccatcgtaaatccccattaaataaacacaacgcattgatctgactttgatttattttctggagcagactcgcaaagtagaatgcgcaatgcggcaacggtgtggagaagggataaaaaaacgggcaagtcagtgacctgcccgttgattttcagagaaggggatttagtacagcagacgggcgcgaatggtacccggaatagctttcattgcctgcagcgctttttcggcaacgtcttcgtcggcttcaatatcaataactacataacccatctgggcggaagtttgcagatattgcgcggcgatgttgacgccctgctcggcaaaaattttgttgagcgcagtcagcacacccggacggttttcgtggatgtgcatcagacgacgaccaccgtgcagtggcagcgagacttccgggaagttcaccgcagagagcgttgagccattgtcagaatacttgatcaatttacccgcaacttccaggccgatattctcctgcgcttcctgagtcgaaccgccaatgtgtggcgtcagaaggacattgtcgaattcacacagcggagaggtaaatggatcgctattggtcgccggttccgtcgggaatacgtcgattgccgcccccgccagatgtttgctcgccagcgcgtcacacagcgctggaatatccaccacagtaccgcgcgaagcattaatcagcagcgagccgggtttcattagcgaaatctctttcgcgcccatcatatttttggttgacggattctctggtacatgcagactcaccacatcgctcatattcagcaggtcagaaagatgctgtacctgagtggcgttgcccagcggcagtttgttttcaatatcataaaagtaaacatacattcccagcgattcagccagaatgcccaattgcgtaccaatatgaccgtagccgatgatacccagctttttgccgcgcgcttcaaaagaacccgccgccagtttgttccacacgccacgatgcgctttagcattggcttccggcacgccgcgcaatagcagcagcagttcgccaatcaccagctccgcaacagagcgcgtatttgagaacggtgcgttaaataccgggatcccgcgctttgccgccgcatccagatcaacctggtttgttccgatacagaaacagccaatagcgaccagtttttctgcggcgttgatcacgtcttcagtcagatgggtacgggatcgcaggccgatgaagtgggcatcgcggatggattcttttaattgttcatcatccagcgcgcctttgtgaaattcgatgttggtgtaaccagctgcacgaaggctttccagcgccttttggtgcacgccttctaccagcagaaacttaatcttgtctttctccagcgatacctttgccatttacccaatcctgtcttttgaaatgttgtgtgcggatttgcatccgcctttcaacatatcaaaaaataatattgcggcaatatgaacgtttgcgtcgcgatgttgaggaaatatcacgcaaaagtatttcttggatgaatatgctggtttagaagatttatttagagcaatcgacaattgccaggtaaaaacgtgacacatgtcaccaaatttaatgaagagaatttttttaacgggggaggttcccccgtcagatcatttcacaatagttttgacaccgtcaggtgtgccaatcagcgcaacgtccgcgccacggttagcaaacaaaccaacagtcaccacaccaggaatcgcatttatggcgttttccatcgctatcgggtcaaggatttccatgccgtggacgtcgaggatcacgttgccgttatcggtcactacgccctgacggtattccggacgaccgcccagtttcaccagctggcgcgccactgcactacgtgccatcgggataacttctactggcagcgggaatttgcccagaatatcaacctgcttggaagcgtctgcaatacagataaatttttccgcaaccgaagcaatgattttttcacgggtcagcgccgcgccgccgcctttgatcatttgcatgtggccgttgatttcatctgcgccatcaacgtagatgccaaggctgtcgacttcgttgagatcaaaaacgtgaatgccgaggcttttcagtttttcagtggaagcatctgaactggaaacggccccttcaatctggcctttcattgtaccgagtgcgtcaataaagtgtgcggcggtggaacctgtacctacaccaacaatggtgccgggctgaacatactgaagtgccgcccatcctactgcttttttcaattcatcctgcgtcatgatcgtttcgcctgtggtatgaaatttcacacgcattatatacaaaaaaagtgattcagaccccgttggcaagccgcgtggttaactcatccataaaatatcgcgcaatggcgggcatcccctttcgccccgcaaataaagcatacaacggtctggggatgccgctccacggtgcaaacaggcgcaccagttccccgttcgcaagcccctgtttacaggcaaactgaggcaataacgccacgccattcaacacaaccagggcgcgaactcgctgagcgaaatgcattagcgcaaatccctgatcttttaagctgcgcgttaaccactgatacaaatgttacccgccaacggcttcggtatatgcaacccgacacaaaattgtgtcatagtgcaggaaaaagcatttaccaggagcagacaacagcaatgaaacgcccggactacagaacattacaggcactggatgcggtgatacgtgaacgaggatttgagcgcgcggcacaaaagctgtgcattacacaatcagccgtctcacagcgcattaagcaactggaaaatatgttcgggcagccgctgttagtgcgtaccgtaccgccgcgcccgacggaacaagggcaaaaactgttggcgctactacgccaggtggagctgctggaagaagagtggctgggcgatgaacaaaccggttcgactccgctgctgctttcactggcggtcaacgccgacagtctggcgacgtggttgcttccggcactggctcctgtgttggctgattcgcccatccgcctcaacttgcaggtagaagatgaaacccgcactcaggaacgtctgcgtcgcggcgaagtggtcggcgcagtgagtattcaacatcaggcgctgccgagttgtcttgtcgataaactcggtgcgctcgactatctgttcgtcagctcaaaaccgtttgccgaaaaatatttccctaacggcgtaacgcgttcggcattactgaaagcgccagtggtcgcgtttgaccatcttgacgatatgcaccaggcctttttgcagcaaaatttcgatctgcctcctggcagcgtaccctgccatatcgttaattcttcggaagcgttcgtgcaacttgctcgtcagggcaccacctgctgtatgatcccgcacctgcaaatcgagaaagagctggccagcggcgaactgattgacttaacgccagggctattccaacgccggatgctctactggcaccgctttgctcctgaaagccgcatgatgcgtaaagtcactgatgcgttgctcgattatggtcacaaagttcttcgtcaggattaatccatcaaataatgcctgatagcacatatcaggcgttatcctcacttctttttgtattccttgaatcacattacaaaatagacaaatctcaggcggcaaaaaacgacgtctgaatgcatttttttgctggagacaaacccacgtaaaaagctcaccgtaagcgcaaataccctcattttgattgcgttttacggagcaaataatgtctaacgtgcaggagtggcaacagcttgccaacaatgaattgagccgtcgggagaaaaccgtcgactcgctggttcagcaaaccgcggaagggatcgccatcaagccgctgtataccgaagccgatctcgataatctggaggtgacgggtacccttcctggtttgccaccctacgttcgtggcccgcgtgccactatgtataccgcccaaccgtggaccatccgtcagtatgctggtttctcgacagcaaaagagtccaacgctttttatcgccgtaacctggccgccgggcaaaaaggtctttccgttgcgtttgaccttgccacccaccgaggctacgacttcgataacccacgcgtggcgggcgacgtcggcaaagcgggcgtcgctatcgacaccgtggaagatatgaaagagctgttcgaccagatcccgctggataaaatgtcggtttcgatgaccatgaatgacgcagtgctaccagtactggcgttttatatcgtcgccgcagaagagcaaggtgttacacccgataaactgaccggcaccattcagaacgatatcctcaaagagtatctttgccgcaacacctatatttacccaccaaaacagtcaatgcgtattatcgcagacatcatcgcctggtgttccggcaacatgccgcgatttaataacatcagtatcagcggttaccacatgggtgaagcgggtgccaactgcgtgcagcaggtagcatttacgctcgccgataggattgagtacatcaaagcagcaatctccgccgggctgaaaattgatgacttcgctcctcgcctgtcgtttttcttcggcattggcatggatctgtttatgaacgtcgccatgttgcgtgcggcacgttatttatggagcgaagcggtcagtggatttggcgcacaggatccgtataacaacgttatccgcaccaccattgatcattgtgcacatcctatgtgtcgggattatctgcatcgctatctggaaaatgcgtccggcggacatattcaccacgatcttagccacgtcttcgacttacaccgtaatttaattgcaaccggatcgatgccgggttaatggtttgtcccgtaacgatcttcagcaatatgctgaagcatcgtggcggtataacgatgatttctgattgaataaagatattcctgcatatacatcggcctgtgcggcgcatcaaaatatttcagcgttgccggattcaccagtcgccaggcaaaatgcgggatcaccgtcagaaaatgtccccgctccacgtcgctgattttggccataaaactatagggacgataaataatggttggattgatcccacaaggacgcatattcgcatcaatcattgcttcgaagttagcccggttttgaaagcgcatttgtagccagggcagctcctgaagcagctcttgctcctgtcgcccttcataacggcgagaaacgtgaaagcccaatcgcagcggtggtagttcactgatagtcaggttttccagttcctgaactcgtgcagatacatgctgtggggagataataaaatctaactgacggtcaaaaagattatcgataacgccattttcgctgaactcaactggctggatggtcacgccttcgtacttatctccgagactaatcaactgatcaaaaataattgtcggataagtattatctatgcctatcacaatttctcgtgaacgacgtcctgagttatggatttcattatcaatcgcagaaagtcgttgataaaccgggaacagtttttgatacagttcctgtccggctttattgaggctgatattattatctttgcgggtaaatagcgtatagccaatttgttcttccagcgcggcaatgcttttgccaaatcgcgaagccgtcatatggattttttctgccgcccgggcaatattattggtttgcgctaataaaatgaaattgcgcatctttttcgaaataaaaatgtccatcccccctctcccgcatccttgtccgcttaaccgtttcagtcagcctatccttgatgaaaccgcgagcaaagataggtgattacgtcatggttttacagaaaaaggaggcaatatcgggtaaaggcattagcccgacgaatacgtcgggctacaagtattaatgtgcagcaggtgttttagcggggggttgatccacaggttctaactggaagaccacatcgacctgatcatcaaactgaatagcggcctgctcgtaagtttcctgtgcggacaccggtgcagcatcagctttcatcatccgcaccattgggctgggctgatagttggaaacatgataacgcacgctatataccggccccagtttgcgattaaagccattcgccagttcctgcgcctgatgaatcgcgttatcaatcgctgccttacgcgctttgtctttataggcatccggctgcgccacgcccagcgacacagaacgaatttcgttaagacccgcctttagcgcgccgtccagcaaggaattcagtttgtctaactgacggagcgtgacttccaccgttctcactgcgcggtagcctttcaggatacttttaccatcctgataatcataatctggctgagtgcgtaagttcgctgagctgatatcttttttcgcgatctgattgagctcaaggaaggaaatgtattgtgcgacgcgctcatctgcctgtttcttggcagtagcggcatccttcgcggccacgttaacttcaatcgcaagagtggcaatgtctggcaccgcatccacgcttgccgtaccggaggtgacaatatgcggtccatccggcaattcgttagcctgcgctgccatcccgctaatacccattaatgccgccagggcgataactttgaacttcacgttagtctctccgtgttaattgacttgcccaaaattcaggacctctggaggcaagcttagcgcctctgttttatttttccatcagatagcgcctaactgaacaaggcttgtgcatgagcaataccgtctctcgccagctgcaaggcaataaaccacataacacatcccactaccagattgataatgcgctgtgattttgccgtgcgcaggcgcggtgccagccaggctgcgagaatagccagaccaaagaaccacaggaaagaggcgctaattgttccgagcgcaaaccaacgttttggttccacatcaagttgcccgccaaggctgcccagcacaacaaaagtatccaggtaaacatgcggattcagccaggtcactgccaacatggtggcgataattttccatctgccttgtttcagaacttcggcactggctaactcaatgttactgctcattgctgttttaaaagcgccaaaaccataccacagcaagaaggctacgccgccccaggtgaccagcgccagcaaccacggcgactgcatcaataacgcgctgccaccaaaaatccccgcacaaatcaggaccaaatcgctgatagcacaaagtaaggcaatcataatgtggtactgacgacgaatgccctgattcatcacaaaagcattttgtggaccgagcggtaggatcatagccgccccaagtgcaagaccttgaaagtaataagaaaacacgttggatattccgaattaagtatctgatgcagagactatatcgcgggattgttattagcggaaattgataatattaattggcaatcagaaaaactaataagagagaggccagagagtattatctggcctcagcgttgattacgcagctttgtcttctttcacccgcttaaagttcacatccatttgcgggtacgggaagctgataccggcggcatcaaattcacgtttaatacgctccagcacatcccagtacacgttttgcagatcgccgctgttgctccagacgcggaccacgaaattaatcgacgatgcgccaagttcgttcagacgcacagtcatttcgcgatctttcaaaatgcgatcttcagactggataatatcggtcaggatctgcttaacctgatcgatatcggaatcatacgccacgccaataataaattcgttacggcgagctggctcgcgggagaagttaataatattcccggcaataattttaccgttcggaataacgataattttaccgtctgcagtacgcatggtggtggagaaaatctgcacactcagcacagtaccggctacgccgccgaggtcaacatattctccggcacggaacgggcggaacatgacaagtaacacgccagcggccaggttagacagtgacccctgcaaagccagaccaacagctaaacctgcggcaccgagtacagcaatgactgacgctgtttgtacgcccacgcgtcccagtgctgcgattagcgtaaaggcgataattccgtaacggactaatgcagaaagaaaatcagcaacagtggcatcgattttacgggagatcatcaggcgattcaccgcgttggaaatcatccgcgcgataatcaaaccaacgatgatgatcgcgagtgccgccacgatgtttactgcataacttagcagcagcgcctggttagccaccagccagcttcccgcgccgtttatgctatcgacaacattcaaatcttccattcaatattccttttcaactgactcaaaatggagaaatacactccgccgccttatgacgggcagtctgacaagggtaaacaataaagcataattttgccaaatagatcacagatttctcatctgtatcaccttgcttttggcgaaaaaaagacccgcagagcgggccttgagataagcagaaaggaatatcttacagaacgtcgatcgcgttcagttcctggaatgctttttccagacgagcgatcatcgaagtctgaccggcacgcagccatacgcgcggatcgtagtatttcttgttcggctgatcttcgcctttcgggttgcccagctggccttgcaggtaagcttcgttttctttgtagtagttcagaacaccttcccaggttgcccattgggtatcggtatcgatgttcattttcactacgccgtagcttacggagtctttgatttcctgagcagtagaaccggaaccaccgtggaagacgaagttcaggctgttgtgcggcaggttgtgtttcttagaaacatattcctgagagtcgcgcaggatggtcggagtcagaaccacgttacccggcttgtaaacaccgtgtacgttaccgaaggacgcagcgatggtgaaacgcgggctgattttgctcagctcggtgtatgcgtaatcaacgtcttccggctgggtgtacagtgcagaagcgtccatgtggctgttgtccacgccgtcttcttcaccaccggtgcaacccagttcgatttccagagtcatgccgattttggacatgcgctccaggtatttagagcagatttcaatgttctcttgcagagattcttcagacaggtcaatcatgtgagaagagaacagcggcttaccggtagcagcgaagtgtttttcacccgcgtccagcagaccgtcgatccacggcagcagttttttcgcgcagtggtcagtatgcaggatcaccggaacaccgtagtgttcagccatctggtgaacgtgatgcgcaccagagatcgcacccaggatagcagcgccctgcggaacgtcagatttcacgcctttaccagcgataaaagaagcaccaccgttggagaactgaacgataaccggcgctttaactttagctgcggtttccagtacggcgttgatggagtcagtaccgacgcagtttactgctggcagtgcgaagttgttttcttttgctacctggaaaactttctgtacgtcatcaccagtgattacgccaggttttacgaaatcaaaaatcttagacatgtctcttgtcctgtatcgtcgggccttatactcgtcatacttcaagttgcatgtgctgcgtctacgttcgctcaccccaatcacttacttatgtaagctcctggggattcactctcttgtcgccttcctgcaactcgaattatttagagtatgaaaaagtgcgtgctctaaaagcgcgctgaaacaagggcaggtttccctgccctgtgattttttacttcttagcgcgctcttcgagcatcgctactgcaggcagtactttaccttccacgaattcgaggaatgcgccgccgccagtggagatgtaggagattttgtcagcaatgccgaacaggtcgattgctgccagagtgtcgccgccgccagcgatggagaacgcttcgctgtctgcgatagcgttagccacgatttcagtacctttgcggaagttcgggaattcgaacacgccaaccggaccgttccacagaatggttttcgcattcttcaggatttcagccagttcctgagcggaagcatcaccgatatccaggatctgctcgtcagctttcacatcgttaacagatttcagggtagccggtgcagtttcagagaactcggttgctacgcgaacatcagacggaaccgggatgttgcaggtggtcagcagacgtttagcttcgtcaaccaggtcagcttcgtacagggatttacccacatcgtggccttgtgccgcgataaaggtgttagcgataccaccgccaacgatcagctggtcagcgattttagacagggagtccagaacggtcagtttggtagatactttagaaccaccaacgatagccaccatcgggcgagcaggttctttcagtgctttacccagcgcgtccagttcagctgccagcagcgggcctgcgcacgcaacgtcagcgaatttaccgataccgtgagtagaagcctgcgcgcggtgagcagtaccgaatgcgtccattacgaacacgtcacacagtgcagcgtattttttggacagagtttcgtcatctttcttctcgcctttgttgaagcgaacgttttccagaacaaccagttcaccttcagcaacgtcaacgccgtcgaggtaatctttaaccagacgaaccgggttagacagtttgtctttcaggtagttaacaaccggcagcagagagaattcttcgttgtactcgccttcggtaggacgacccaggtgggaagttaccatcacttttgcgccttgtttcagggccagttcgatggtcggcagagaagcacggatacgcgcgtcgctggttactttcccgtcttttactggtacgttcagatccgcacggataaatacacgtttcccagcaagatccagatcggtcatcttaattacagacatggtgaatcctctcgttgattctaaaagttttgcagacgctgcttgcgtcttacctgaaagcaacagtagccatagctaacgtcgtgtcgagcattcggttagcaaagccccattcgttatcgcaccagaccaacgttttgatcaggtgtgcgccactgacccgggtttgagtgccatcgacaatggcactgtgcggatcgtggttaaaatctacagagaccaacggcaattccgtatagtcaactataccatgaaatgcaccttgtgctgctttttgcagcaacaggttgacttcattggcttttacaggtttcttcaccgtcacgcttaaatcgattgccgtcacatttatggttggcacacgtaccgcaatcgcctcaaagcgatcgttaaattgcggaaaaaatcgtgtgataccggcggccagtttagtatcgaccggaatgatcgactgactggctgcccgagtgcgacgcaggtcaggatggtatgcatcaataacctgttgatcgtgcatggcggagtgaattgtggtcacagtgccggactcaataccgtacgcatcatctaacaatttgatgacgggaattatgcaattcgtggtacaggaagcgttagaaacgatgcggtgttccgcacgaagttgatcctgattgacgccataaacaacggtcgtgtcgagatcgttactgccaggatgtgaaaagagcacttttttagccccggcggcaatgtgtgcttcaccatgctcgcgggagccatatacgccggtgcagtcgaggactacatcaacgccaagttcacgccaggggagcgattgcagtgaacgttcatgcaatacacggatggcgtcatcaccaacaaaaagttgatcgcgttcctgtcgtacttcccatgcaaaacggccatggctggtgtcatatttcaacaaatgcgccatgcccgcagcatccgccagttcgttgattgccaccacggtaatttccgcacggcgtccggattcatacaaagcacgaaccacattacgcccgatgcgaccgaagccatttatcgctacgcgtacggtcatagatctcctgcaaggttttccctgagcaaatttgccagacagagtaatccagcaaatcgttcggggaaaccttacctgtcgcaaactgcgactgattggttaattgtcgaacatttaatcgactgaaacgcttcagctaggataagcgaaacgtggaataaaaggaatgattgtccagtcaaagaagacaattatctgacttacgtcacgttttcagccccgcccctgtggaatttattccactttgcagaatcacgaataagcgtagcaaaatcttttcgttgtgccgtcacaaaccctgacttatatcagaatatgactgatgcagcgtcgatattatccgcaatacgtccgagtttcggagtactccaatgatgacattgccctacccatattcttcctccgcacgtttttacgcgctgcgcctgctccccgggcaggaagttctctcccaattacgcgccttcgcgcagcaacaacaactccacgccgcgtggattgcaggttgtaccggcagtctgactgacgtcgccttacgctatgccgggcaagaaaacactgccctgctaagcggtaagttcgaagtcatcgcattgaacggcacgctggaacagagtggtgaacatcttcatctctgcgtttccgatccacacggcacgatgcttggcggtcatatgatgcccggctgtaccgtgcggaccacgcttgaactggtgatcggctgcctggaggaactggcgtttagccgccagctttgcgcgctttctggttacgacgagttgcatatttcccccgttaaataactattttcagagaggttttcttatggcgcgtcgccacttttccagtcaggcactggtgttgatcgttatctctatcgccatcaatatgatcggcggacaactggccagcatggttaaattacctatttttctcgactccatcggcacacttattagcgcggtactgcttggtccggtgatcgggatgctgaccggtttactgaccaatttactctggggattgctgaccgacccgatcgccgccgcatttgcgcccgtcgcgatggtcatcggcctggtcgccggttggctggcgcgagcgggttggtttcgcaccctgccaaaagtcgttgttagcggcgtgattattacgcttgcggtaacggtcgtcgctgtaccgctgcgtactgcgctgttcggcggcgtgacaggaagcggagccgatttgttcgttgcctggatgcactcgatggggcaaaacctggtggagtcggtggcgattacggtgataggcgcgaacctggtcgataaaattctcacagcggtgattgtctggcttttactgcgtcagctgccgattcgcaccacgcgccattttccggcaatggctgccgtgcgctaaatgcatccgtttacatccttaacgctgtgggcgctggcggcctgcaccacgcttatcctgcccacacagacaatattgccagtctatagcgcggcgacctttttctgccttattgcgctaaaggccacgcggcggcgggcaaaatatgtcgtctggctgatgttctcgctgggggctggattgtggctggtgcacggtggctggctgacagaatggctaagcggcacgccacgctctccagaacggtgggcgcatgctattacgctctggttgcggattctggcgattgtttcaacctcacagttgtggatgcagtacgtccccgtgcaacgttttatccgcgctttgtttgcttctcgcctgccgccgggcgtcgcttatctgtttgccgggccgttattggtcgttgagcagttaaaacggcaattggcgattattcatgaagcgcagcgcgcccgcggcgtgccgctggatgagggctggtatcagcgtttacgtgcgatgcccgcgttaattattccgctaacacacaatgcgctaaacgatcttgctgtccgtggtgcggcgctggatatgcgggcatttcgaatcaacaataggcgcactacgttatgggcaccagccgatagcaccctacaacgcgtagcacgttacaccatgatattgctaatgctggctgaattcggagcgtggatatggttacgttagaacagtttcgctattgcccgacacactcaacgcatcctccgttctgttatgactttcactatgtcaaaccggggatggtcgccatctttggtgacaacggcagtggcaaaagtacgctggcgcagctgatggcgggctggtatccggactttctaccaggagagataaccggcacggggacgcttctcggtacgcccattgggcgtctcccgcttaatgaacaatccgccaccatccagctcgtccagcaatcgccctatttgcagctctccggctgtacctttagcgtggaagaagaagttgcctttgggccagaaaatctgtgtcttgctgaaaaagagattatggcgcggattgacgccgccctggccctgaccgagtgccagccgttgcgccatcgtcacccggcaacactctccggtggagagacacagcgtgtggtcatcgcctgcgccatcgcgatgcagccaaagctcttaattcttgatgaagcctttagccgcctgacgccgaaggccagcgaaatgctgttgcagcgcttacaacactgggcgcttgaacgtggttcgctgattattctttttgaacgtcatcacacacctttcctgaaccactgccagcaagcgtggcaattgcaaaacggagcgctccagccactatgttaacgttaaatcagatatcttatcgctggcctggcgcggcaacggattgtctttgcgacatttctctgcaactcaaacaaggtgaatggctggcgctgaccggcgacaatggcgcgggaaaatcgacgctgttacgagtaatggcaggtcttcttacgcccacagccggtacggttatgctgcaacaacaagcgatgaaaaacctgaaaaaccgccagcgcgcggcaaagattggcgtactgtttcaggaagcggaaaatcagctttttcacagcaccgttgctgacgaaatcgcatttggtttgatactgcaaaaatgcccggcggatgaaatcactcaacgtaccaatgctgccctgcaatgctgtcagttagcagacactgccagcgcgcatccgttagatctgcatagtgcgcagcgacggatggtcgccgtcgcctgcctggaagcactctctccgccactattgctactggacgagccgagtcgggattttgacgaaaattggttgagcgtgtttgaaagctggctggaaaagtgccgccagcgaggcacgagcgtcgtagcaatcagtcatgacgccgcatttacccggcgtcatttctctcgtgtggtgcgactggaagatggtgtaatcaggaacgttaatccatcagacgatattcacccgtagcggtcatcattaaggtcaaatttgcaggcagactctcttccagcacccggcgaacattcggcccgtcggtacggtcataaaaggcttctgcgtctgccagcgataaccctcccgccagcttgcgccccaccagacgctcccgcaacgcagatgcgggagctttgataaagatcgagaaatcacaaaattgcgcaagctggcaccacttctcgtcgtccaacaacaaccagtttccttcgacgatgacgagtggtgcggtaacgtgcaacacatcttcaacaggatcatgcttttgtcgatcgtactgcggccacgtacaatccccttccacaacccggcacagattttccgccagtttcgcaacgttgaatgtctctggtgcgcctttgaagggtcgcaattgatgcacatccagccagctattgtaatggtgaaaaccatccatcggcagcgtctgaatagcgggcagttccgggtcttgttgtgcgagatattcccagaaggtggttagggtagatttacccgtccccggcggagcgcaaagaaaaaccaccgtacgccgctgcggatttactgtctgtaaggccgccagcatacgcagcaatggtttatgtacattttcaatttcatcatcagagtactgcgcctgtacctttagtccattcaccgtcagttcgattttcacggcgttaattcctttaaggtggtcgttactgccagcgtcagcgccgttttgaccatcccgctaaaacgcgcctctgaccagacggcgaaatcggcgaacttcatcgctttcaacgcgtcatagagcgtcgcattgcgggttatgctattgacgttgctgataaaatcccaggttatgtcatcagcaaatctgggcgtttcatcctgttcgttcagataatgccaaaactgggaaaaatgcgtgatatcggcgtacagccatttatccattttccccagcgcataaatcaaacgcagcgcaacatcaatatcgtcaagcgggccgctttgggcgagtaacggcttcactgcatattcgacgatctcttcatcgttatcgacaaacagcgacggcagaaactggcgtatcccctggagcaaaatagaatgcgcaattttcataaatgaaaataaattgtcctgtgcattcagttgctcaagcacatcatcttctgtcagcgtcgccattggtcttccgatagatcaccatcaatgcagggagtctattatattacacgtttggtccgcgccgccgatcagtaatgtctgcgtccgcaccccattcgccgtctgttggataccgttcaccaactcgccgcccgtcacgcccgtagcgctaaagaggatatcgttccccctcgccgataaccactcgcccacgaaaagcaacgtcgtttaatgcctggcgcatcgtggtgaccgcaaggccatcaattttatttttgtcgccacagccggtttgcggccaggcagccaacgctgcctgttccgtaacgcgaaataatggccacgccagggacatcattgcgcggcctccccaatatcaacgccaaattgtgccagcagatatttctcggcctgttcattccagataccgtgcgttttctcaaccagccgcgccagctctttaaacagcggatcggttttgcctttttcggcaaaatcggcaatggcggtcagcggcatggtcacgccgttataaatgagttttttaccgccagggatatccggcagattgagcacggtttctggcaccgcatccaggccaccgatatgggtcaccataaacgacggctgtaactgccccgtggcgctaagggcaatcgcctctttcatgtcgtccgtggaaccgccggacgtgccgacaatgtgcgtactgttgtaatggacgttgtagaaattaaacggcactttgaagtttttatccgtcggcccggcaaagaagttcaggcagccatcttccgccagtaattcatcagccatctcgacgactgaaggcaccgctgcatagacaaatacgtcatcaaatccggcatcatccgtcagcgcccgcagcgtctggaccggatcgctcatccctttggtattcatatacaccagctcaatgcctttactggccgccagttccaccggcagcagcttttgtacctgcgtcaggcgtttgtcgtcgatatcgactaccaccacccgcgccggttggttgccgccgttaatggcgtaatcaatagcgccaattcccatcgggcctgcacacgccagtagcgcaatattgccaccaggtttgacgcccatgcgatgctcataaacatattgcgtggtgtgataattggcatgataagcgccaataatgcagcacatcggttccgccagcgaggccgcagcaaaataagagccgtgatacggtaatacacagcctaaattaatcgcgatttcgggaataatcatataggtggcgttaccgccaaaatattcgtagctgtagcccgctgaatacccgcctggtaaccccatcgccggttgcaatacaaaacgctggccttttttatatttgccagtgagatttttacccacttcgacaataaccccggcacattcatgcccggtaatgaccggatgattttctaaatcgtcggggacgcgtttatgttcactaccgagtaacgccgctttccaggtggataaacaaacgctgtcagaaattacattcactaacagttcattatcggtaatttctggcagctcaaattcgcgcagacggacatcccgcttgccataaatagcagcaactttggttttcatttttacctctgtaatcagtgtttatgttcagcggttaattgattaaataaagtgtcgagttttggatcgccaatatagttattaatcaatatcagtggtttatccgtcacacgtttcacgcgcccttccagactggcgtgagtaacgacgatatccgcatccgcaggcacgttttctatggcgtaatgttttacttcaattgccagccccgctttttccagacgtttacggaaggtggttgcgcccatcgcgctggagcccatccccgcatcgcaaacaaaggcgatacgcttaacccggcttaacgagaatgccccctcttgtttcatcgccttaaccgcattggctgactgagcaaactcatcttcgctctccgtttccaccgttttttccatcttcagtatcagcgaagtgatagcaaaggacaccagggtacctaccgtaacaccggcaattgtcgccaggaacgagcctttcggcgtcagtgccaggtaagcaaagatagaccccggacttgggccagccaccagaccaccgtccagtaagttaaacatccaggtgccagacataccgcccgcaatcatggcaataatggtcagcggcttcatcagcacatacgggaaatacagttcgtggatcccaccgaggaagtgaataatcatcgccccgggcgcagaacgtttactcatccctttaccaaacaaggtaaacgccagcagcagccccagaccaggacctggattggaggccaccatgaagaagatggatttaccgttaaccgaagcctgttgcattcccagcggataatagacgccctgatcgatcgcattattaaggaaaagcactttcgccggttcattgatgactgacagcaaaggtagataacccgcatgtaccagcgcctcaatacactctttgacgaaagtattagcaattaacaccgccgggccgataacttcaaaacccagcagacaaaggagcatccccgcgatacctaatgagaagttattgataaccatctcaaaaccagcaggtatgcgtttttccagcgacttgtcgatatatttaatcaccagaccaccgagcggccccataatcattgagccaaggaacatcgggatttcagcgccgacgatcacaccaatcgtaccaattccgcccatgaccgcgccgcgtttaccgccgaccagatgaccaccggtagaaccaatcatcacgggcaataaataggtaatcatcggaccaacaattttggcgaaatgttcattcggcagccagccggtgggaataaataatgccgttataaatccccaggcaataaaagcaccgatattggggatgaccattgcagtcaaaaagcccccaaaagcctggacctttgcacgagcagacttgttttccataatattatcctgtagaggagagagtaattatccgcggctgataatgtccgctaattgtttttctgatgatgcggttaagagttgttcgagtatttcttcttcgcacagtaattcacttaacgcctgaatagcgccaatgtgcgaattggcatcggcagcagaaagcccgatgagtaatttaatcggttcgtcattccccggaaaataaacgctttgtttaagtaacgtcaaagacatcccggttttaagcgccccacattccgatcgctcatgaggcattgccacgcctggtgcgagaatataataagggccattgttaatggtggaacctttaattgcctgaatgtaattctcgctgatatagtttttatccagcaatgataccatcgagaaatcgatagcttcctgccaatcttttgctgaatgtataactgagattgatgattttggaaaataatcaataagccgcataaattatccttattttatttttagggtacagtccggcggtaaaaataaaatacgcgtacaaattaacgaaagcaattggacacatgaaaggagaaactccacgagcaaaaataacaaaatattgaataacaacaacatgaaataagcttttaaaaagtcaattataaatctgttaagtaaactacaaaatcaacaaattattcatcactatatttgtgatacacatctctattttcttattgaatgttcgaaaacatacttattacgtttattattttttcgctcatcccctttataaattctgaattatcggctgttgtctgttttctcatcacctcatgtgacatattccccactttactcaaggaagattcatatgaaagcacctgtttcattaacctcatttcgcccacaaaaatctcttgctatcgccattggcgtgcttgccgtggttgtgctgccatttctctcgtattacaccgttaatgaaggtgaacgcggcattttgctgcgctacggaaaaatcgtaaaagttgccgagccggggctgggttttaagatcccttttatggaaagcgtagagaaaatttccacgcgtaatcaggctgtggtctatcagggattacaggcctacagccgcgaccagcaaccggcacaaatgacagtatcagtcagcttccacattaaaccttcagaagcaggcgcggtttataccacctacaacaccattgaagcattaaaagatcgtctgattgtccgtcagttgccaactcaactggagaacgttttcggacaatataccgccatcagcgccgtacaggatcgtacaaaactggttcaggatctgcaaaatgccatgcgcaaagccgttgttgggccagtggtaattgacggggtccagattgaaaatattgatttttctgacgcttatgaaaagtcgattgaagaccgaatgaaagcagaagtcgccattgccacgcgtaagcaaaatctggaaacggagaaaatccaggcgcaaatagcggtaactcaggcccaggcggaagcagacagtaaactagcggcagccaaagcagaagcggaaactattcgcgtaagaggcgcggcagaggctgaaactattcgtttaaaaagtgcggctgaagcagaagctatccgcctgcgcggtgaagctctgcgggagaatcccggacttgttgccctcaccactgctgagcgttgggacggtaaactgcccgataccatgatccccggcagcacagttccgtttatctctactaagtaaaaaagggccgctttcgcggcccttgagactgatagcaaagacaaaactgcctgatgcgctacgcttatcaggcctacatacttcctgcaatatgttgaatttgcaaaatcttgtaggacggataaggcgttcacgccgcatccggcataaacaacgcgcactttgccaacaatctgaagggccgcatttgcggcccttctcacaaagcatcttaccgattacagcagcgcttttgctttcgcaacaacgttgtcaacggtgaagccgaactcttcaaacagctgctctgccggagcagattcaccgaaggtggtcatgccgacgatagcaccgttcaggccaacatacttgtaccagtagtcagcaatgccagcttccaccgcaacacgagcggtaaccgctttcggcagtacggattcacggtaagccgcgtcctgcttgtcgaatgcgtcggtagacggcatggaaaccacgcgcgctttcacgccttcggcagtcagtttttcgtaggcggcaacagccagttcaacttcagaaccggtcgcgatgaagatcagttccggctgaccagcacagtctttcagcacataaccaccgcgcgcgatgtttgccagctgctcttcagtacgttcctgctgcgccaggttctgacgggagaggataagcgcagtcgggccgtcctgacgctcaacgccgtatttccacgctactgcggattcaacctggtcacacggacgccatgtagacatgttcggggtcacgcgcagagaagcgatctgttctaccggctggtgagtcgggccatcttcgcccagaccgatggagtcgtgggtgtaaaccatcacctgacgctgtttcatcagcgcagccatacgtacggcattacgtgcgtattccacgaacatcaggaaggttgaggtatacggcaggaaaccaccgtgcagggagataccgttggcaatcgcagtcataccgaattcacgtacaccgtagtggatgtagttacccgcagcatcttcgttgattgctttagaaccagaccacagggtcaggttagacggcgccaggtctgcagaaccgccgaggaattccggcaacagcggcccgaacgcttcgatagcattctgagacgctttacggctggcgatcttcgccggattagcctgaagtttagcgatgaactctttcgctttggcgtcgaagtcagacggcatttcgcctttcatacggcgggtaaattcagcggcttcctgcggataagctttcgcgtaagcagcgaatttctcgttccatgcggattctttcgcctggcctgcttctttcgcatcccactgagcatagatttcagacgggatttcgaacggcgcgtatttccagcccagctgttcgcgggtcagggcaatttcagcgtcgcccagcggcgcaccgtgggagtcgtgggtaccggctttgttcggggaaccgaaaccgatgatggttttgcacatcagcagggacggtttgtcagtcactgcgcgcgcttcttctactgcgcgtttgatggatgccgcgtcatgaccgtcgatatcgcgaataacgtgccagccgtaagcttcgaaacgcattgcggtgtcgtcggtaaaccagccttcaacgtgaccatcgatagaaataccgttgtcatcgtagaacgcaatcagtttacccagcttcagcgtacccgccagagagcaaacttcgtgggagatgccttccatcatgcaaccgtcgcccatgaaggcgtaggtgtagtggtcgacgatgtcgtggcccggacggttaaactgcgccgccagcgttttttctgcaatcgccataccgactgcgttggcaataccctgacccagcggaccggtggtggtttctacacctgcggtgtaacccacttccgggtgacccggagttttagagtgcagctgacggaagtttttcagttcttccatcggcagatcgtaaccggtgaggtgcagcaggctgtagatcagcatggagccgtggccgttggacagcacgaagcggtcacggtcagcccaggacggattctgcgggttgtgtttcaggaaatcacgccacaggacttcggcaatgtcagccatacccataggggcacccgggtgaccggatttggctttctgtactgcgtccatgctcagcgcacgaatagcattggcaagctctttacgtgaggacattttgactccagatcggatgatgaagggcacgcccttaacgacttgacgacagcgcgttttgggctacgccggaaaatttgccaacaatttaccgcaagccgctcgtcatgtacatggaacatccttttgccgcttcagaaatctctggatcatgctcgcatgttgcgcaatccactcgcccgtccgctgcgcttttccttatactgagactgagcgtcgattcacctgcaaacggcgcatttttagaataatcctgaccttgtgcggaagagaaaacatgaaaattcgcgccttattggtagcaatgagcgtggctacggtgctgaccggttgccagaatatggactccagtggactgctctcatcaggagcggaagcttttcaggcttacagtttgagtgatgcgcaggtgaaaaaactgagcgatcaggcatgccaggagatggacagcaaagcgacgattgcgccagccaatagcgaatatgctagacgtctgacgacaatttctcgcgcgttaggcgataacatcaacggtcagccggtgaattacaaagtgtatatggcgaaggatgtgaacgcctttgcaatggctaacggctgtatccgcgtctatagcgggctgatggatatgatgacggataacgaagtcgaagcggtgctcggtcacgaaatggggcacgtggcattaggccatgtgaagaaaggaatgcaggtagcacttggtacaaacgcaattcgcgttgcggcggcctctgcaggcggaattgtcagcagtttgtcacaatcacaactgggagacctgggcgaaaagctagtcaattcgcaatttacccaacgtcaggaatcagaggccgatgattactcctacgatttgctgcgccaacgcggtatcagcccggcaggtcttgccaccagctttgaaaaactggcgaaactagaagaaggccgccaaagctcaatgtttgacgaccatcctgcatccgccgaacgcgcccagcatattcgcgatcgtatgagcgcggatggagttaagtaaagccaggtagtgccgaacgtaggtcggataaggcgttcacgccgcatctgacaagaatggcacatttgttactccgtgcgcattgccggatgcgatgctggcgtatcttatccggcctacgggtgccgagtgtaggtcggataaggcgttcacgccgcatccgacattaatggcacatcacccgcgcgcctcttatctggcgcttactcgccctttttcgccgcctggatatacagcatctccagcgccagcgtcgccgcagccagagcggtgatttccgactgatcgtatgccggagccacctccactacgtccatcccaacgatgttgagatctttcaagccgcgtaccagtttaatggcgcgatcggaggtcaggccgccaattaccggcgtaccggtgcctggtgcaaaagcaggatccaggcagtcgatatcaaaggtcaggtaaaccggcatatcacccacaatctgtttcacctgggcgataatgtcatccacgctgcgatcgttcacctggcaggcgtccagcacggtaaagccgttgtctttatcaaactcggtacgaataccaatctgcacagaatgattcgggtcgatcagaccttctttcggcgcggtatagaacatggtgccgtggtcaaattcacaaccgttagcgtaggtatcggtgtgggcatcaaagtgtaccaacgccattttgccgaaatgcttcgcatgagcgcgcagcagcggcagcgtaacaaagtggtcaccaccgaaggagagcatacgcttaccggcagccagcagcttctcggcatgcgcctgcagcttctcgctcatctcacgggcatctccgaaggcatataccagatcgccgcagtccacgacgttcaggcgctcacgcatgtcgaaattccacgggaagcgattgtgttcccaggccagattcgtcgaaacctgacggatcgctgccggaccgtggcgaccacccgcacgaccagaagtggccatatcgaacggcacgccagtaatcacccagtcagcatcgctgtcatatggctggaagttcatcggcaggcgtaaaaaaccaaaggcgttggaaaccagtgagttatcgtattgatgacctaaggtgctcatggatggactcctattacaaagtcgatataaaaaaacccttccgcgtcgttaggcccgacgaggaagggttggatttgtgaaacacaagtttgtgctaattatcgccttaaatgggcgaggcatcaagcgaggttgctatttccgacacggtggcggcgcatagccattgttatctgccggaaaggcttgtccagagcacggcggcagcgcgtttttcgccgggccttgtaattcaaaggcggcaaagccgattacaccggtattacgcacatcgccttgcgccgaattggctgcgtaggaatcagcaacgttggcgaactgaaaagccgcttcggtatgtttatctttgcggaatcctttaatcgctaacgaatctccggcattcacaatataaccgttgttattcagcgaaccttgcttgccgttcagcacatccaggccatcaaccgtagcaacgatctcgtagttggtgttacgactgtaattacggacatataattgataattcattccgactctggcatggacaatatagcgtggttcattattggatgaatcataaacccgcgtaataggtagagaattaaaattaccatcgcgaatagcatattccagttcgttaatacgaatgctataaacgcggtcgtagccggaaggaacattagtcgaataactaataacgatcatctctgccggatcgcgccaggctcgttcagcagatacgccctgaaccgttgagtgcacatccccaccccaggcggtgccgacattgcctgatgcactgctattatactgcgcattactggaacaaccagccagcagcacgattaatgccaccaacgcgctacgtactttccattttttcataaccgttccctctgcatttaattaatgcagcgattgtagggagattatttaataagaaaagcagctaaattatttttaagaatatataaaaagaaagcgggccgatttacgtaaataaatcgccccgccagcagaataatcttaattattcatcttcaagataggtataaccgtacaaacctgcctcgaactcttccaggaactgttgttgcagttcagcatcaagatcggttttcttcacctgatcgcggaactgagttaacagcgttttcggatcgagctgcacatattgcagcatgtccgccacggtatcgccttcgtcagacagttctacctctacgctaccatcagggaagacgaacacgtcaaccgcttcggtatcaccgaacaggttgtgcatgttgccgaggatctcctgatatgcgccgaccataaagaaaccgagcatcggcggattctccggatcgtactccggcataggcattgtcgtggcaataccgtcaccatcaatatagtggtcgatagcaccgtctgagtcacaggtaatatccagcagcacagcgcggcgttccggcacttgatccagcccttccagcggcagaaccgggaacaactggtcgatcccccacgcatccggcatcgactggaacagcgagaagttgacgtacattttgtccgccatacgttcctgcagctcgtcgataatcggacgatgagcacggttttgcggatccagctgcttttgcacttcatggcacatgctcaaataaagctgctcagcccatgcgcgttcttgcaggctaaaggtgccggaagagtagccgatatgaatgtcgtgcagatccatctggctgtcgtgtaaccattcacgcagagaacggcgagttcccggttcgtgcatttcctgccaggtttcccacatgctttgcagggcgcgcggtgcgtcttctgcaggcgcggtcggcaccgtgtattcgttacgttccacgccgatgatattcgacaccagcacggtgtgatgcgcagtcaccgcacgacccgattcggtgattaccgtcggatgtggcagaccattttcttcacacgcatcaccaatcgcccagatgatgttgttggcgtattcattgaggccgtagtttacggagcagtcagactgagaacgggtgccttcatagtccacgcccagaccgccgccgacgtcgaagcactgaatattgacgcccagcttgtgcagttccacatagaaacgcgcggattcacgaacgcctgtcgcgatatcgcgaatattcgccatctgcgaaccgaggtggaagtgcagcagttgcaggctgtcgagacgcccggcttcacgcagcgtttcaaccagttgcagtacttgagtcgccgccaggccaaacttcgatttttccccgccggaggactgccatttacccgagccctgcgaagccagacgtgcacgcacgcccagacgaggaacgacattcagacgttctgcttcatccagcacaatggcaatttctgacatcttctcaatgaccagatagaccttgtggcccatcttctcgccaattaatgccaggcggatatattcgcggtccttataaccgttgcagacgatgacgctacgggtcatgccagcatgtgccagcaccgccatcaactcggctttggaaccggcttccaggcccagcggttcgcccgaatgaatcagggactcaatcacgcggcggtgctggttaactttgatcggataaacgaggaagtaatcgccgttatagccgtaggattcccgcgctcgtttgaacgcggcgttaatggaacgcaaacggtgctgcaggatctgtgggaaacagaacagtgcaggcagacgctgaccctgtgcttcgcgagttttcactaactgcgcgagatcgacgcgagcttccgggacgtccgggtccgggcacacgctgatgtggcccagctcgttaacgtcatagtagttattgccccaccaggcaatattgtaagtacgcagcatcttgctggcttcctgggagctcattgcaacctcctgcatggagcgtagtacaccgtgttcgcccgctgacgaaggcaaacccatagacatgtcgtcagacatagcgaacctcaaattattttattaagtgtaaaacagttaacgactatcgcagcctggaactgcgataacaacccataagcacatggattttccagcagtgaatgctgacgctccaactgcgcaaccggtttctttttcataacattattaagcacataaccgaacgtaagtgtgacagttcggcgaaaccacgagaaaactcttgtttttacaagagcgcccttgttcagtcctcagtagctgtaaccagctcttgaatcctgagaagcgccgagatgggtataacatcggcaggtatgcaaagcagagatgcagagtgcggggaacgaatcttcaccagaacggtgagacaggttaagcagcagacaacggttcattatttcgtatcacctccacggccgcctgttaagacgaacccacaagccaaaactctgttttcaacccggctggaagtggcaacacgaaagaaacgtcgtgtgctttttatttaagccgcgcgccgcgttttataccccacaatggcagaaaattgcaaaagataaatacgcagaatgccagcattgtcaggaaaaatttccagccacgtttttaacagaatgagacacgattcaaaaaaaagtggaaattgggtgaagaactgacctaaaatagccatccagatgttaatccatccataccgattaacactcagactgccagtgtttttaacctgcagagtcgtggtaggatccgctaccacagaaaatccacacaacagtttgagctaaccaaattctctttaggtgatattaaatatggcaaaacacctttttacgtccgagtccgtctctgaagggcatcctgacaaaattgctgaccaaatctctgatgccgttttagacgcgatcctcgaacaggatccgaaagcacgcgttgcttgcgaaacctacgtaaaaaccggcatggttttagttggcggcgaaatcaccaccagcgcctgggtagacatcgaagagatcacccgtaataccgttcgcgaaattggctatgtgcattccgacatgggctttgacgctaactcctgtgcggttctgagcgccatcggtaaacagtctcctgacatcaaccagggcgttgaccgtgccgatccgctggaacagggcgcgggcgaccaggggctgatgtttggctacgcaactaatgaaaccgacgtgctgatgccagcacctatcacttatgcacaccgtctggtacagcgtcaggctgaagtgcgtaaaaacggcactctgccgtggctgcgcccggacgcgaaaagccaggtgactttccagtatgacgacggcaaaatcgttggcattgatgctgtcgtgctttccactcagcactctgaagagatcgaccagaaatcgctgcaagaagcggtaatggaagagatcatcaagccgattctgcccgctgaatggctgacttctgccaccaaattcttcatcaacccgaccggtcgtttcgttatcggtggcccgatgggtgactgcggtctgactggtcgtaaaatcatcgttgatacctacggcggcatggcgcgtcatggtggcggtgcgttctccggtaaagatccatcaaaagtggaccgttccgcagcctacgcagcacgttatgtcgcgaaaaacattgttgctgctggcctggccgatcgttgtgaaattcaggtttcctacgcaatcggcgtggctgaaccgacttccatcatggtagaaactttcggtactgagaaagtgccttctgaacaactgactctgctggtacgtgaattcttcgacctgcgtccatacggtctgattcagatgctggatctgctgcacccgatctacaaagaaaccgcagcatacggtcactttggtcgtgaacatttcccgtgggaaaaaaccgacaaagcgcagctgctgcgtgatgctgccggtctgaagtaatctttcttcacctgctttcaaaggccagcctcgcgctggcctttttcttttacctcaccgcagtggacaggcgttcacgccgcatccggcaaaaaaccgcccgcacaataacatcattcttcctcaacacgttttaccgcaaattatcatcactactgaaatcgattacaccaaccacaccagcgaaatatttgtaatattttcatattattattcagctttcacagttgttacatttcttttcagtaaagtcttaattgcagataacaacctttaatctatgatgatataactcaattattttcatgcacttaaatcataactaagataaatgctagtgtaagcgattacactgatgtgatttgcttcacatctttttacgtcgtactcacctatcttaattcacaataaaaaataaccatattggagggcatcatgcctgacgctaaaaaacaggggcggtcaaacaaggcaatgacgtttttcgtctgcttccttgccgctctggcgggattactctttggcctggatatcggtgtaattgctggcgcactgccgtttattgcagatgaattccagattacttcgcacacgcaagaatgggtcgtaagctccatgatgttcggtgcggcagtcggtgcggtgggcagcggctggctctcctttaaactcgggcgcaaaaagagcctgatgatcggcgcaatcctgtttgttgccggttcactgttctctgcggctgcgccaaacgttgaagtactgattctttcccgcgttctgctggggctggcggtgggtgtggcctcttataccgcaccactgtacctgtcagaaattgcgccggaaaaaattcgcggcagtatgatctcgatgtatcagttgatgatcactatcgggatcctcggcgcttatctttctgataccgccttcagctacaccggtgcatggcgctggatgctgggtgtgattatcatcccggcaattttgctgctgattggtgtcttcttcctgccagacagcccacgttggtttgccgccaaacgccgttttgttgatgccgaacgcgtgctgctacgcctgcgtgacaccagcgcggaagcgaaacgcgaactggatgaaatccgtgaaagtttgcaggttaaacagagtggctgggcgctgtttaaagagaatagcaacttccgccgcgcggtgttccttggcgtactattgcaggtaatgcagcaattcaccgggatgaacgtcatcatgtattacgcgccgaaaatcttcgaactggcgggttataccaacaccaccgagcaaatgtgggggacagtgattgtcggcctgaccaacgtacttgccacctttatcgcaatcggccttgttgaccgctggggacgtaaaccaacgctaacgctgggcttcctggtgatggctgctggtatgggcgtactcggtacaatgatgcatatcggtatccactctccgtcggcgcagtatttcgccatcgccatgctgctgatgtttattgtcggttttgccatgagtgccggtccgctgatttgggtactgtgctccgaaattcagccgctgaaaggccgcgattttggcatcacctgctccactgccaccaactggattgccaacatgatcgttggcgcaacgttcctgaccatgctcaacacgctgggtaacgccaacaccttctgggtgtatgctgctctgaacgtactgtttatcctgctgacattgtggctggtaccggaaaccaaacacgtttcgctggaacatattgaacgtaatctgatgaaaggtcgtaaactgcgcgaaatcggcgctcacgattaatctcctcaggcttcctcccatcatggaggaagccacctcttgcagtcatcttttcttcgctctatcctctgccgctatgaaaacatcccgtctccctatcgccatccaacaggccgttatgcgtcgcctgcgggaaaaactcgcccaggccaacctgaagctagggcgtaactacccggagccaaaactctcttacacccagcgcggaacctctgccggaacagcctggctggaaagctatgaaattcgcctcaatcccgttttgctgttggaaaacagtgaagcctttattgaagaggtagtgccacacgaactggcacatttgctggtatggaaacatttcgggcgcgtagcgccacatggcaaagagtggaagtggatgatggaaagcgtgctgggcgttcccgcccgtcgtacgcatcagttcgaactgcaatccgtgcgccgcaacaccttcccctaccgctgcaagtgccaggagcatcagcttaccgtacgccgtcataatcgcgtagttcgtggcgaagccgtctatcgctgtgttcactgcggcgaacagctggttgcgaaataaccacctgaactatcaggaactttcctgatctggctgattgcataccaaaacaactttcgctacgttgctggctcgttttaacacggagtaagtgatgtaccgttatttgtctattgctgcggtggtactgagcacagcattttccggcccggcattggccgaaggtatcaatagtttttctcaagcgaaagccgcggcggtaaaagtccacgctgacgcgcccggtacgttttattgcggatgtaaaattaactggcagggcaaaaaaggcgttgttgatctgcaatcgtgcggctatcaggtgcgaaaaaatgaaaaccgtgccagccgcgtagagtgggaacacgtcgttcctgcctggcaattcggtcaccagcgccagtgctggcaggacggtggacgtaaaaattgcgccaaagatccggtctatcgcaagatggaaagcgatatgcataacctgcagccgtcagtcggtgaggtgaatggcgatcgcggcaactttatgtacagccagtggaatggcggtgaaggccagtacggtcaatgcgccatgaaggtcgatttcaaagaaaaagttgccgaaccaccagcgcgtgcacgcggtgccattgcgcgcacctacttctatatgcgtgaccaatacaacctgacactctctcgtcagcaaacgcagctgttcaacgcatgggacaagatgtatccagttaccgactgggagtgcgagcgtgatgaacgcatcgcgaaggtgcagggcaatcataacccgtatgtgcaacgcgcttgccaggcgcgaaagagctaacctacactagcgggattctttttgttaacccctaccccacgcgtacaaccgcgtggggagacgacgcggatttttaactatgcgtatcccccgcatttatcatcctgaaccactgaccagccattctcacatcgcgctttgcgaagatgccgccaaccatatcgggcgcgtactgcgtatggggccgggacaggcgctgcaattgtttgacggcagcaaccaggtctttgacgccgaaattaccagcgccagcaaaaaaagcgtggaagtgaaggtgctggaaggccagatcgacgatcgcgaatctccgctgcatattcacctcggtcaggtgatgtcgcgtggtgaaaaaatggaatttactatccagaaatcgatcgaactcggtgtaagcctcattacgccacttttttctgagcgctgcggcgttaaactggatagtgaacgtctgaacaagaagctccagcagtggcagaagattgcaattgctgcctgtgagcagtgtggccgtaaccgggtgccggaaatccgtccagcgatggatctggaagcctggtgtgcagagcaggatgaaggactgaaactgaatcttcacccgcgcgccagtaacagcatcaatacgttgccgttaccggtcgaacgcgtccgcctgctgattggcccggaaggcggtttatcggcagatgaaattgccatgactgcccgctatcaatttactgatatcctgttgggacctcgcgttttgcgtactgagacaactgcgctcaccgccattaccgcgctacaagtgcgttttggcgatttgggctaacggagaagaataatgatcaagctcggcatcgtgatggaccccatcgcaaacatcaacatcaagaaagattccagtttcgctatgttgctggaagcacagcgtcgtggttacgaacttcactatatggagatggccgatctctatttgatcaatggtgaggctcgcgctcgtacccgtactttgagcgtcgaacagaactacgataaatggtacgagttcacgggtgagcaggatctgccgctggccgatctcgatgtgatcctgatgcgtaaagacccgccgtttgataccgagtttatctacgcgacctatattctggaacgtgccgaagataaagggacgctgatcgttaacaagccgcagagcctgcgcgattgtaacgaaaaactgttcactgcctggttctctgacttaacaccagaaacgctggtcacacgcaataaagcgcagctaaaagctttctgggaaaaacacagcgacatcattcttaagccgctggacggtatgggcggcgcgtcgattttccgcgtgaaagaaggcgatccaaacctcggcgtgattgccgaaaccctgactgagcatggcactcgctactgcatggcgcaaaattacctgccagccattaaagatggcgacaaacgcgtgctggtagtggatggcgagccggtgccgtattgcctggcgcgtattccgcaggggggcgaaacccgtggcaatctggctgccggtggtcgcggtgaacctcgtccgctgacggaaagtgactggaaaatcgcccgtcagattgggccgacgctgaaagaaaaagggctgatttttgttggtctggatatcatcggcgaccgtctgactgaaattaacgtcaccagcccaacctgtattcgtgagattgaagcagagtttccggtgtcgatcaccggaatgttaatggatgccatcgaagcacgtttacagcagcagtaacccaccttagcgagaaggatctcgttgagactctgagtgacagcgcccttctttccacgcatactgggcgctgttgcttttttgaaccaggaaacagaacctctgacaatgaatttacagcatcactttcttattgccatgcctgctctccaggatccgattttccgtcgttccgtggtctacatttgcgaacataataccaatggtgcaatggggatcatcgtcaacaagccgctggaaaatctcaaaattgaagggattctggaaaagctgaagatcacgccggagccgcgtgatgaatcaatccgtctggataaaccggttatgctcggcggtccgctggctgaagatcgcgggtttattttgcatactccgccctccaattttgcttccagcattcgcatttcagacaacacagtgatgaccacttcccgcgatgtgctggaaacgctcggcaccgataaacaaccgtctgacgtattggtggctctgggttatgcctcctgggagaaaggtcaactggaacaagaaattctcgataacgcgtggctaacggccccggcagatctgaatattctgttcaaaacgccgattgccgaccgctggcgcgaggcggcaaaactgattggtgtggatattctcaccatgcctggtgtggcaggacacgcctgatgagtggaaccttactcgccttcgacttcggcaccaaaagcattggcgtagcggtcggccaacgcattaccggcaccgctcgccctttgcctgcaattaaagcgcaggacggtacgccggactggaacattatcgagcgtttactgaaagagtggcagccggacgaaatcatcgtcggtttgccgctgaatatggacggcaccgaacagccgttaaccgccagagcgcgtaaatttgccaaccgtattcatggtcgtttcggtgttgaagtaaagctccatgacgagcgtcttagcaccgtggaggcacgttccggtctgtttgaacagggcggctatcgggcgctcaacaaaggcaaagtcgactctgcctctgcggttattattctcgaaagctatttcgagcagggatattaaggcgatttactagcgcacagatttctgacaatgtgctcgttgtttcatgttggatgcggcgtaaacgccttatccaacctacagtgagtgcgaattcaaagttacgcttcccttgtaggcccgataagcttgcgcatcgggcatatttacaattcgtatcagacacagcaacgtcacaagcgcccttctttcacccgctgctgataactctgctgaaacgttatcatccccacctgctgcccggtttgaataacatgcggtaactggtgggttttcccttcacgaatcaaattccccaccgcgggtgtgttaatcagtaattcaaacagcgccacgcgtccttcctgtttatccacttccagcttttgtgacaacaccgcccgtaaactacctgccagttgattacgcacgggatctttttcctgcgccggaaacgaatccaccagtcgctcaactgcctgcgctgcgccgcgcgtgtgtaatgtcgccagcaccagatgcccggtttctgccgccgtcagcgccagacggattgtctcgctatcacgcagctctccgagcaaaatcacatcaggatcttcccgcaatgcagcccgcaatcccgatgcgaaagtcatacagtgcaaaccaatctcccgctgttggatcaaacatcgctgactggtatagagatattccacaggatcttccagcgtcagaatatgcgcatcggcatgttgattgagatagccaaccatcgccgccagcgtggtagatttgccgctccccgtcgcccccgtcaccagaatcaggccattctcgctcttgagtaattccggcaataccggtggtgcgccaagctgttcgagctgcgggcagtgcgaaggtaacagccgtaacgccagagaaataccttgccgttgtgcgaacgcactgccgcgcaatcgctggttttccgccagcgacacagcaaaatccagctgaccattctccagcaatattgcccgctgatcgtcatccagccactcccgcagtagctcttcgacgtccggcgcgtcaaacggcgcagcttccattctcccgcgaatacgccatcgtgcgggccaggcgctgcacaggtgtagatccgagacgttatgctttacactaagggccacaatttcttccatattcatactaagatcctcggaaaatgaacgatattgcgcataacctggcacaggtccgggacaaaatctcagcggctgcaacgcgttgcggccgttctccagaagaaattacgctgcttgcagtcagtaaaacaaaacctgcgagcgccatcgcagaagccattgatgccgggcagcgtcaatttggtgaaaactacgttcaggaaggggtagataaaattcgccactttcaggaactgggcataacaggattagaatggcattttattggcccgttgcagtctaataaaagccgcctggtggcagagcatttcgactggtgtcataccatcgaccgtttgcgcatcgctacccgtctgaacgaccagcgcccggcagaacttccccctcttaacgtactgattcaaattaacattagtgatgaaaacagtaagtccgggattcaactggctgaactggacgagctggcagctgcggtcgctgaactaccgcgtttacgtctgcgcgggctgatggcaatccctgcgcctgagtcagaatatgtaaggcagtttgaagttgcacgccaaatggctgtagcatttgccggactgaaaacgcgctacccgcatatcgacacgctctctctgggaatgtcggacgatatggaagccgccattgcggcaggtagcacgatggttcgtatcggcactgcaatttttggtgcgcgtgattactctaaaaaataaggaattaaaggaacgccatgaatacgttgactttcctgctttcaacggtcattgagctgtataccatggtgctgttattacgcatctggatgcagtgggctcattgtgatttttacaaccccttctcacagtttgtagtgaaggtaacgcagccgattatcgggccactgcgccgcgttattccggcaatgggacccattgatagcgcctcgctgctggttgcctatattctcagtttcgttaaagccatcgtgctgtttaaagtggtgaccttcctgccaatcatttggattgccggtttattgattctgctgaaaaccatcggcctgctgatattctgggtcctgctggtgatggcgattatgagctgggtaagccagggtcgtagcccgattgaatacgtgctgattcagctggccgatccgctgctgcgcccgattcgccgcttgctaccggcaatgggtgggattgatttctcgccgatgatcctcgttctgctgctgtatgtcatcaatatgggtgtcgcagaagtcttgcaggcgaccggaaatatgctgctgccggggctgtggatggcgttatgagtgccgtaacagttaatgatgacggtctggttttacggctctatattcagccaaaagccagccgtgattctattgtcggtttacatggcgacgaggtaaaagtcgccattaccgcgccgccggttgacggccaggccaacagccatctggtgaagtttctcggtaagcaattccgggttgccaaaagccaggtggtgattgaaaaaggcgaacttggccgccacaaacaaattaaaatcattaatccgcaacaaatcccgccagaaatcgcggcgttaattaattaggtatcctatgcaaaaagttgtcctcgcaaccggcaatgccggtaaagtgcgtgagctggcgtcgctgcttagcgacttcggtcttgatatcgttgcccaaacagacctcggcgtagattccgctgaagaaaccggcctgacctttatcgaaaacgcgattctgaaagcgcgccatgcggcaaaagtgaccggtttaccggcaattgccgacgactccggtctggcggtagatgcgctgggtggcgcgccgggtatttactccgcgcgttattccggtgaagacgcgaccgatcaaaagaatctgcaaaaactgctggaaacaatgaaagacgtaccggacgaccaacgtcaggcgcgtttccactgcgtgctggtatatctgcgtcacgcggaagatcccactccgctggtatgccacggtagctggccaggcgtgattactcgtgaaccagcgggcactggtggctttggttatgatccaatcttcttcgtaccttccgaagggaaaaccgctgccgaactgacccgcgaagaaaagagcgccatttcccaccgtggtcaggcgttgaaactgctgctggacgctttacgtaatggttaaattaccgccgctgagtctctacattcacatcccgtggtgcgtgcagaaatgcccgtactgcgatttcaactctcacgcgttgaaaggagaagtgccgcacgacgattatgttcagcatctgcttaacgatctggacaacgatgtggcttacgctcagggccgtgaagtaaagacaatctttattggcggtggtacgccgagcctgctttccggcccggcgatgcaaacgctgctgaacggcgtacgtgcgcgtttgccgctggcagcggatgcagaaattacgatggaagcgaaccctggtacggttgaagccgatcgctttgttgattatcagcgtgctggtgtgaaccgcatctccattggcgtacagagttttagcgaagaaaagctgaaacgacttgggcgcattcatggcccgcaagaagcgaaacgagcggcaaatctggcgagcggtttagggttacgtagctttaacctcgatttgatgcatgggctaccggatcaatcactggaagaggcgctaggcgatctgcgccaggctattgaactgaatccgccgcatctttcctggtatcaactgaccatcgaacccaatacgctgtttggctcgcgccctcctgtactgccggacgatgacgcgctgtgggacattttcgaacaggggcatcagttattaaccgcagcgggttatcagcaatatgaaacttccgcttatgccaaacccggttatcagtgccagcacaatctcaactactggcgctttggtgactacatcggtattggctgcggcgcgcatggcaaagtgaccttcccggatgggcgcattctgcgtaccaccaaaacgcgtcatccgcgtggttttatgcaggggcggtatctggaaagccagcgtgatgtcgaagccgcagataaaccatttgagttctttatgaatcgcttccgtttgctggaagccgcgccgcgcgtggagtttagccagtatactggcctttcagaagaggttattcgcccacagttagaagaggctatcgctcagggttatctcacagaatgtgcagattactggcagataacggaacatgggaagttgtttttaaattcgttgctggagctttttctggcggagtaaatttgtattgccggatgcggcgtgcgtgtacgcagcatccggcaacaactcatgcgtcatcgcaaaaattacttaatcaccccattgcgccgcagttgttcggtatcttttttccagcgttcattagcctggttgatatcgtcaattttcatcaaaatcgcgacttttttactgtttatttctgaaactttcatcgttaacggatattgccctttttcgagcgttatccagtcatcctgcaatttacggctaagtttttgtgattgcagaaaagtctgtcgccgttgttcgttgatatcaaaatctcgtttctgctgaattggcacttcataacactcttcactctgtttatgacatgccgcaatcgccggttgataaacctctttgtcatatttaaccgcgaacgcctcactatcgttctgtttattaaaatcatcacgctgttggtgaatttttttaaaggcgtcttcgcgggtcatttgcttaccgtttgcatcttttccccaatatgcatccgctgctttctgcgccgccaccatttgcttatcaagcgcttttacatcctttttcagtgcaggaatcgagttattctggttattcaacgcagactcaagctgactaaagcgataattgaaatcttcgctattcacgatcagatatttattattcgttttgatatcgtcaaccacccgcccacgatcgctggctgccgcctgaaaagagtaaaagttcaccgaccagccagacgcgggcgttcctttactggttaacatcgccgagaatttcaccggtttatctttcgtccaggtctgttcgagcagctcgtaatctgccaactgaccgacccaggtatagagatcgtcactggaagagacatcgccttccgctgaccaggtggcctgattacccttagcatcaagattttttaaggtgatgacatcaagcttgagaatgccgtgatactgctttttgaattgatcttttaagatattttcagttggcggttcaccatctgcccggacattaccagtcatcaacataaacagcgccgtaccaacaatccattgctttttcacccgaaaaccctcgcgcggaataatttattccggtgattatcattagggtaataaaaattggcaatggacgtgagtctgaagtgaataagccccggcacgataccggggcgaagtgattagtactgattgaagatctgctggatctgctgcggatctttagtttgcgtcagagccagttgcagcagaacgcgcgctttttgcgggttcaacgtgccagaggcgacgaagccgtatttcgcatcatccacttcggcatcctgagtggtagcgcccgtcggtacgcgggaagaacgcactactgcagtgccgtttttcgcagcggttgcaagggtgtcaaatacggttttatacaggttgccgttacccacgccagcgctaacgatgccatcatagcccgcatctaccagtgctttagccggaagatcggatgcgttagcgtagttataaacaatgccgactttcggcagttcattcagcttagagacatcgaacggcgtgtcgctggtgtgcttacgtgccggggtacgttggtagtcaatcttaccgttgtgaatgtaacccagaggaccgtagttaacagacttgaaggtcgctacgtcggtggtgttggttttggtgacatcacggccatcaagtacggtgtcgttcatcactaccagtacgccacgattagcggaggctttatcagctgcggtcactaccgcgttatacaggttgaatggaccgtctgcgctcatagacgtggacgggcgcattgcaccgaccatcaccaccggtttgtcgcatttcaccgtcaggtcgaggaagtaagcggtttcttccatcgtgtcggtaccgtgggtaatgacgaagccgtcagttttatcgcagtcggtgttaatttttttcgccagtgtcagccagacatcatcgttcatgtcctgggagccaatattcactacctgctcgcctttaacgttcgcaatgtccttcagttgcggcaccgcattaaccagattttctacgccaactttacccgctgtgtagttagatttggttgcggagtcaccaccaccggcaatggtcccgccggttgctaaaatggtgatattgggtaatgccaatgctgcaccactaaaacccataaccagtgcggcaagtgccgtctttttgaaaaactccatttcattcctccagttacgtgaacgctacgcattatcccttagctttgcatgggaaatttgacgttaaacaatttacaacgtgaatatattttggagatctacaaagttagaggcaggtaacaaaacgaagaattaaacggcataaaaaagtattatgccgtcttaaaatagaggattattttaaattcccgaccagggctttgcggctatcttccagagtcacaacgcggctacaaacatctttgccaaactgctggaaatctttttcctgctttttccactcggtttggattgaggattgcaggccgcccaggcttcccagcacgttctgtaatgggttaccgccgcttttcagcaccgctttcgcgcccatttcattaatgctgtcctgtaaaattccgcccattgcctgattcactaattgctggccttcggcacgaacctgatcaatggctttatagtgaaacgtcaggccatcgctgcgcgtttcgataatgcggttcatctgctctttcagctgcgcatcaagtttggtcagacggctgcgcattttgctgctttcgcccatctcctgaacgataattttatccagcgcaatacgagctttctcgacgcggcttttcgcgccttcatcaatccacggcagggtgctacgtagttcagcctgataatccttcgcctgctcgcgctgggcggcattcagggaatattgcttaccgttatacatcacgttgccgtctggcgtgatcaccagattgccgttttcgcccttcacctgcacggtttgcgggctgacaatcacatcgtcacgcggcgtgacgctgcactggtagtcggcgtgagcggtcattgccgtcactgaaagtgctgccgccagcagcattttgcgcatcatagtcttccctcaagaacaaatcaggccagcatttgctggccccagattgataacaaagtgcgcgttttccatgccggatgcggcgtaaacgccttatccggcctactcgatcgtgcatctttgtaggcctgataagcgtagcacatcaggcagttttgcatttgtcatcgcccgtatgctttcttagtcccaccaaacgtcgaaaagttcgctggtgcgtacctcttccagtttgcgttcttccagccacttacgcacaatcgcctgatgttcttcggtgcatttgccgatttcctgcatgcagatcagaccttcccaggccagataaccgctgccgtcaaaggccagtttgttcggttcgataacctcgttaataaagtcatcaacggttttatcaatctgttcttccgatgtaccttccgggaatcgccatgccaccgaaaatcctaattcctggaattcgtcgatgtgcatttttttacgcagacgacggctacggttctttgccattatttcaccctctcgaacattaagtcccatactccgtgaccaagacgatgaccacgttgttcaaatttcgtcaccggacgtgatgccggacgcggtacgtaatcattgctctctgacaggtttttataaccgtcaatagaagacatcacttcaagcatatgttccgcataaggttcccagtcggtcgccatatggaatatgccccccagctgcagtttgctttttaccagctcggcaaacggcacctgaacgatacggcgtttattatggcgcgctttgtgccacgggtcagggaaaaagagctgcaccatgcgcaatgaattgtcaggaatcattttatgcagcacttcaaccgcatcgtgacacatcacgcgcaggttgcttaagccctcttcatgcgcagaagacaggcacgcaccaacgcccggtgaatgcacttcaatgccgaggaagtcctgctcggggcgatctttagccattgccaccaacgacgcgcccatgccaaaaccaatctcaagcgtcaccggcgcttcacggccaaaaagcgcagggaaatccagcatatcttcgctgaactcaacgcccatcaccggccagtagttttccagcgcatgttcctggcctttggtcagtcgcccctggcggcgcacaaaactacggatacggcgcagcgggcggccgttttcatcaaattccggtgagatgacgtcgtttttcataaagatttagtcgcttgtgaaagtgttctgaaaacgggcattatccaaagttagttgccggatgcaagcatgataaggccgtggctgcggaaagttccggtttacaccctgccgtcgctgtgctgcaatcttgcccccaacaacagtgaattcggtgaccatgcaagcgtcgcaattttcagcccaggttctggactggtacgataaatacgggcggaaaacgctgccctggcaaattgacaagacgccctacaaagtatggctctcagaagtgatgttgcaacaaactcaggttgcgaccgttatcccctattttgaacgctttatggcgcgcttcccaacggtgaccgatctcgccaatgcgccgctcgacgaagttctccacttgtggaccgggcttggctattacgcccgcgcgcgcaacctacataaagcggcacaacaagtggcggccttacacggcggtaaattcccggaaacctttgaggaagttgcagcactgccgggcgtcgggcgttccaccgcaggcgcgattctctcgctttctctgggtaagcactttccgattctcgacggtaacgtcaaacgcgtgctggcgcgctgctatgctgtaagcggctggcctgggaaaaaagaggtcgagaataaactatggagtttgagcgagcaggtgacgcccgcggttggcgtggaacggtttaatcaggcgatgatggatttgggcgcgatgatttgtacgcgctctaagccgaaatgttcgctctgtccgctacaaaacggatgtattgccgccgccaacaatagctggtcgctttatccgggcaaaaaaccgaaacagacgctgccagagcgcaccggctactttttgctgttacagcacgaagatgaagtattgctggcgcagcgtccgccgagtggattgtggggcggtttatactgtttcccgcagtttgccgatgaagaaagtttgcggcagtggctggcgcaacgacagattgctgccgataacctgacgcagctgaccgcgtttcggcataccttcagccatttccacttagatattgtgcctatgtggcttcccgtgtcgtcattcaccggctgcatggatgaagacaatgcgctctggtataacttagcgcaaccgccgtcagttggcctggcggctcccgtggagcgtttgttacagcagttacgcactggcgcgccggtttagcgcgtgagtcgataaagaggatgatttatgagcagaacgattttttgtactttcctgcaacgtgaagcagaaggtcaggattttcagctgtaccccggcgaactgggaaaacgcatctataacgagatctccaaagaagcctgggcgcagtggcagcacaaacaaaccatgctgattaatgaaaagaaactcaacatgatgaatgccgagcaccgcaagctgctggagcaggagatggtcaacttcctgttcgagggtaaagaggtgcatatcgagggctatacgccggaagataaaaaataaaaacagtgccggagcacgcctccggcaacttgcataaaaacaaacacaacacgcacccggaatgatgaaaaaatatctcgcgctggctttgattgcgccgttgctcatctcctgttcgacgaccaaaaaaggcgatacctataacgaagcctgggtcaaagataccaacggttttgatattctgatggggcaatttgcccacaatattgagaacatctggggcttcaaagaggtggtgatcgccggtcctaaggactacgtgaaatacaccgatcaatatcagacccgcagccacatcaacttcgatgacggtacgattactatcgaaaccatcgccgggacagaacctgccgcgcatttgcgccgggcaataatcaaaacgttgctgatgggggacgatccgagttcggtcgatctctattccgacgttgatgatattacgatttcgaaagaacctttcctttacggtcaggtggtggacaacaccgggcagccgattcgctgggaaggtcgcgcgagcaacttcgcggattatctgctgaaaaaccgtctgaagagccgcagcaacgggatgcgtatcatctacagcgtcaccattaacatggtgccgaaccaccttgataaacgtgcgcacaaatatctcggcatggtccgccaggcgtcacggaaatatggcgttgatgagtcgctgattctggcaattatgcagaccgaatcttcctttaacccgtatgcggtcagccgttccgatgcgctggggttaatgcaggtggtacaacatactgccgggaaagatgtgttccgttcgcaggggaaatccggcacgccgagccgcagtttcttgtttgatcctgccagcaatattgataccggcaccgcgtatctcgcgatgctgaacaacgtttatctcggcggaattgataacccaacatcgcggcgttatgccgtcatcaccgcctataacggcggcgcaggcagcgtgctgcgagtcttttcgaatgacaagattcaggcggccaatattattaacaccatgacgccgggcgatgtttatcagacgctgacgacccgccatccctctgcggaatctcgccgttatctttataaagtgaataccgcgcaaaaatcttaccgccgccgataattccactaaccgcccctgacgatgctcaggggtaaaaatgttatctacatcacaatttcgttttgcaaattgggaatgtttgcaattatttgccacaggtaacaaaaaaccagtccgcgaagttgatagaatcgcatcatctcgcacggtcaaatgtgctttttcaaacactcatccgcatcacgatgtgaggaaattaacatgaatcttaagctgcagctgaaaatcctctcttttctgcagttctgtctatggggaagttggctgacgaccctcggctcctatatgtttgttaccctgaagtttgacggtgcttctatcggcgcagtttatagctcactgggtatcgccgcggtctttatgcctgcgctgctggggattgtggccgacaaatggttaagtgcgaaatgggtctatgccatttgccacaccattggcgctatcacgctgttcatggcggcagaggtcactacgccggaggcgatgttccttgtgatattgattaactcgtttgcttatatgccaacgcttgggttaatcaacaccatctcttactatcgcctgcaaaatgccgggatggatatcgttactgacttcccgccaatccgtatctggggcaccatcggctttatcatggcaatgtgggtggtgagcctgtccggcttcgaattaagccacatgcagctgtatattggcgcagcgctttccgccattctggttctgtttaccctgactctgccgcatattccggttgctaaacagcaagcgaatcagagctggacaaccctgctgggcctcgatgcattcgcgctgtttaaaaacaagcgtatggcaatcttcttcatcttctcaatgctgctgggcgcggaactgcagattaccaacatgttcggtaataccttcctgcacagcttcgacaaagatccgatgtttgccagcagcttcatcgtgcagcatgcgtcaatcatcatgtcgatttcgcagatctctgaaaccctgttcattctgaccatcccgttcttcttaagccgctacggtattaagaacgtaatgatgatcagtattgtggcgtggatcctgcgttttgctctgtttgcttacggcgacccgactccgttcggtactgtactgctggtactgtcgatgatcgtttacggttgcgcattcgacttcttcaacatctctggttcggtgtttgtcgaaaaagaagttagcccggcaattcgcgccagcgcgcaggggatgttcctgatgatgaccaacggcttcggctgtatcctcggcggcatcgtgagcggtaaagtggttgagatgtacacccaaaacggcattaccgactggcagaccgtatggctgattttcgcaggttactccgtggttctggccttcgcgttcatggcgatgttcaaatataaacacgttcgtgtcccgacaggtacacagacggttagccactaattacgcaaagaaaaacgggtcgccagaaggtgacccgtttttttattcttacttcaacacataaccgtacaaccgtttcatgccatccgcatcggtttcgctatagacaccttgcaactccggcgaaaatcccggcaacaaattcacgccttcttccagcgcaaggaaataacgttgaaccgccccactccagacttccccgggtaccacgcaaagcacgccaggtggataaggcaacgccccttctgccgcaattcgcccttcggcatcacgaatccgcaccaactccacttcaccgcgaatataagcgctatgcgcatcctggggattcatcaccactgacgggaaactctgctggcggaacatcgctttttgtaggtctttgacgtcgaaactgacatacaaatcgtgcatctcctgacacaactggcgcagggtgtagtcgcgatagcgcaccggatatttgttataaacgctcggcaacacctcagccagcggcgaatcatcctcaatatgctgttcaaactgcgccagcatcgccaccagttgtgccagcttctcgtggctttccgccggagttaataagaacagaatggagttgagatcgcacttctccggcacaatgccgttctcacgcaggtagtgcgccagaatcgtcgccggaacgccaaagtcgctatattcgccggtttcggcatcgatacccggcgtagtgagtaacagcttgcacggatcaacaaaatactgatccgcggcatatccttcaaagccgtgccaattcgcccccggctcaaaactgaaaaaacggcggtcgctggctaacactgacgtcggataatcctgccacaatttgccatcaacaacgggcgggataaacgggcggaacagcttacagcgcgtaagaatagccttgcgcgactcaatacccaactcaacgcactcagcccacagccgacgcccactctccccttcatgaattttggcgttaacgtccagggcggcgaacagcggatagaacgggctggtagaagcatggagcataaaggcattattcaaccgcttatgcgggcaaaaacgcgcctgtccacggatatggttatcttttttatggatctgcgacgtctgtgagaatcccgcctgctgtttgtgcaccgactgagtcacaaagatccccggatcgttttcgttaagttctaacagcagcggcgagctatccgccatcatcgggataaactgttcgtaaccgacccacgcggaatcaaacagaatgtaatcacacagatgcccaacggtatcgatcacctgacgggcgttatagacagtgccgtcataggttcccagctgaataatcgccaggcgaaacgggcgcggcaggtcggctttttctggcgcaacgtcgcgaatttgctggcgcagatactcttcattaaaacagtgcgcatcaataccgccaatgaaaccaaacgggttacgtgaagcttccagatagaccggcgtcgcccccgcctgaatcaacgcgccatgatgattcgacttatggttgttacggtcgaagagcaccagatcgccacgcgttaacagcgcattcgtcaccactttattcgctgccgatgtgccgttcagcacaaaataggttttatcggcatgaaagactttggctgcaaatttctgcgcatctttcgccgatccttcatgaataagcagatcgcccaattttacgtcagcgttacacatatcggcgcgaaagatgttctcgccaaagaaatcgtaaaaatggcgtccggcaggatgctttttaaagaacgcaccatgttgatgtccagggcaagcaaaggtgctattacccatctcaacgtactgcgtcagcgtgtcataaaacggtggcagcaaattctcttcatactgacaggctgcggattccagctccagccactgctgctcgttgccgttgattaccgccgtaacgcccgcaggtaattcaacagcatgttcggaatacaaaaacaccggtagatgaaaaccggtgcgcttaagcaacgcaagaatgccactgcgactatccgcagcggtaatgacgactgccgcgacgtccgtaaaatcagtatctcccaacgccaccacgcggcgatgagtagaaagtcgggataccagttcactactggcggcaatattcattgatttcataagcgcaaaacccgtttaggggaagtaagaataccggacaaggtggaaaaccctgccccatgagatatgggtcaaactggtcaccagctccgaccaccagacatcagtaaaagcagaaacgctctgattttactgttgtcctgcagtgagcgtgcgttaacttcaccgcatgagcagtagcataaaaagagaagagtttcgcgcaaaacggcgataagcgagagaatgtaaggaggtggcgtgcatcgggcaaactccgtacagagaggagaaaattcgcgcaatcatggcacctttcgctaaagcgcgcaagccaggactttgcgaacaaacaagccatcgacggcgccaaaagttcataataagaaaatcaaacaatacagctaacaggaactcttgtggtcatcggcccttttatcaacgcaagtgcagtcttactgggtggcgttttcggcgcactccttagccaacgcttaccggaacgtatccgcgtctccatgacatcaatttttggtctggcatcgctggggattggtattttactggtggtgaaatgcgccaaccttccggcgatggttttagcaaccttactcggagcattaatcggcgaaatttgtctgctggaaaaaggcgtcaatacagtggtcgccaaagcgcataatctgtttcaccactcgcgtaagaagccagcgcatgaatcttttattcagaattttgtcgcgattattgtcctgttttgcgccagcggcaccggaatcttcggggcgatgaacgaagggatgaccggcgatccaagtattttaatcgccaagtcatttcttgatttctttacggcgatgatcttcgcctgctcgctgggtattgcggtgtcggtgattagcattccattactgatcatccagttaacactggcgtgggctgccgcgctgatattaccgctgaccacaccgtcgatgatggcagacttcagcgccgtaggcggtttattgctgctggcaaccggattacgcatctgtggtattaaaatgttcccggtggtcaacatgcttccagcactccttctggcaatgccgctttccgccgcctggaccgcctggtttgcctgacaatgtgtgcaatagcggcaaagtgatgatagattgtgcagtctgcactaaattgaagaaatttgattgacgagacgaggcgaatcaggtttaatgcgccccgttgcccggatagctcagtcggtagagcaggggattgaaaatccccgtgtccttggttcgattccgagtccgggcaccaaattcatatcaacggacctccacggaggtccgtttttcgtttcagaacgccacaatttaagcgttctgcctccaaatcaattctaccgaactcaaccagattccccccacatcaaccccattgtgtgggtataattgcgggtataccccagttcgacagaatttgtaccctctttaacgcattcagaaggctgaactatggcactgactgacgcaaaaatccgggctgcaaagcacactgacaaggcttataaactcactgacggggctggcatgttcctgctggttcatcctaatggttcccgttactggcgtctccgttatcgtattctgggtaaggagaaaaccctggcacttggtgtgtatccggaagtttctctctccgaagctcgtacaaaacgggatgaggcccgaaaactgatttcggagggggttgacccttgcgaacagaaaagagctaaaaaagtagtccctgatttacaactctcttttgaacatattgcacgacgctggcatgccagtaataaacaatgggcacaatcacacagcgataaagtactcaaaagcctcgagacacacgttttcccctttatcggcaaccgggatatcacaacactcagtaccccggacctgcttatccctgttcgtgctgcagaagctaaacaaatttatgaaatcgccagtcgtctgcagcaaagaatatctgctgtaatgcgttatgccgtacagtctggcatcatcagatataacccggctctggatatggctggtgcattgaccacggtaaaacgccagcatcgccctgcactggatctttcacgcctgcctgaacttctgtcgcgtattgacggttataaaggccagcctgtcacccgactggcagttatgctgaatttactggtttttattcgttccagtgaactcagatatgcccgctggtctgaaattgatattgacaatgccatgtggactattccagccgaacgcgaacctctgccaggcgtaaaattttcataccggggctccaagatgcgaacaccacatcttgtgccactcagccaacaggctgtagccatactggcagaacttcagacatgggcaggtgaaaatggtctgatctttacgggagcacatgacccacgtaaaccaatcagtgaaaacaccgtaaataaagccctgagggttatggggtatgacacaacccaggatgtctgtggtcatggattccgggcgatggcatgtagtgcattaatagaatcaggtttgtggtcccgcgatgctgtggaacgccagatgagccatcaggagcgtaatggtgtacgtgctgcgtatatccataaagccgaacatctggaagaacgtcgacttatgctacagtggtgggcagattttctggatgcgaacagagaacaatgtatcagcccgtttgaatatgcaaagattaacaatccattaaaatagtaatcatcccgggcagccagcccgggaattattttctgaatatttttctttgtgagtaactggaaaaaggatagcgaagtaaattactttaatgaattattccaggggctcattaaagttctttcgtaatactttgtagtcaaacacgttatggctggcatcaaaaaccaggtaatgactccaacttattgatagtgttttatgttcagataatgcccgatgaccttgtcatgcagctccaccgattttgagaacgacagtgacttccgtcccagccttgccagatgttgtctcagattatgtcgctcaatgcgctgagtgtaacgcttgctgataacgtgcagctttcccttcaggcgtgattcatacagcggccagccatccgtcccataccacgacctcaaaggccgacagcaggctcagaagacgctccagtgtggccagagtgcgttcaccgaagacgtgcgccacaacagtcctccgtatcctgtcatacgcgtaaaacagccagcgctgacgtgatttagcaccgacgtagccccactgttcgtccatttcagcgcagacaatcacatcactgcccggttgtatgcgcgaggttaccgactgcggcctgagttttttaagtgacgtaaaaccgtgttgaggccaacgcccataatgcgtgcactggcgcgacatccgacgccattcatggccatatcaatgattttctggtgcgtaccgggctgagaggcggtgtaagtgaactgtagttgccatgttttacggcaatgagagcagagatagcgctgatgtccggcagtgcttttgccgttacgcaccacgccttcagtagcggagcaggaaggacatctgatggaaatggaagccacgcaagcaccttaaaatcaccatcatacactaaatcagtaagttggcagcattaccgatttgcagcatactaatttcagtaagattgccgcccttcttgtttaaaaggcggcattactagcccagtaaagatttaactcggacttatacctttaaatatccaccaataaacagggcaacgacgataatatcgcacagcaacagcataatcagataaatcagctcttttttggtaaatatcggctgaccatcatttttttcttttcttgaccagataaagaccggcagaccacaggtcaacaggataggaattaatgcaacatactcaatctggctggcgtaaagaataaacagacagaatagcgagcctaaaacaccgctggacaaagccagcctgcggcctttttttgcatactgatcatattttccgtttctgcaaatactggtcagatacagcgtggtggtaatataggccggaacaaccatcagcgcactgatattatacatggtggtccaagcattatttgaaaaataaacaagtaacatggccgcctgcatcacaaagctactaacccacagtgacacattggccgcctgtttactgttcgttcgggcaaacgcgcgcgggaaagcgcctttctgtcctgctaccatcggtatttcagcgcatagcatggtccaggcaagccagccggccagaacagaaataatcagccccgcgctcatcagccagtcgccccactgaccgacaacgtgggcgagcacgcctgcggtagaggggttactgacctgcgctagttctgcctgaggcattacaccgaacggcagaatggacattaacatataaataattagcgccagcagaaagccgatcagtgtggctttccctacgtcctgtttatttttggcacgtccggatagaacaaccgctccctcgacgccaataaaggcccagagcgttacggtcatcggtgccagaatctgagacagcagcgatactggtgcggcgtcatttccgttgccactgaggatcgcgggtgattctccccaaaagtttttaaacaggtccgaataatcgatcagcacacccagcagtaatacgaataggatcagagggacgagcttggcgatggttcccaaggtgttaacaaatccggccactttcgtcccggacagaacaagaaaattatagccccagatcagcactgagccgcagataatggagttcagattattaccatccgtaaaaacccccggcataaactgattaaaagcatccattaaaattaccgcaaaggcaacgttgccaaatgcggtcatcagccagtagccccaggcgacgttaaagccaataaaggaaccaaaaccttcctgggcatacatatacactccagcctgaaggtccgggcgcagatctgatagtacgcgaaaggagtttgcgataaaataaataccgatcccggcaataatccatgcaatgattactggccctagtgcagaagaggccgccgtgttttgcggcagactgaaaacgccgcctcccagcatggagctaacgacaatagcgatgagggatataagccccagcttatgtcctccggcgctattgtcactattttttacatctgaagattgctctgccataacgtttccctcagctattctataatattgccgtcggattgcaggcgatccgacggtattgttctttcccccgcctactggcggccctttttaataccagagacctggcgtttaaaggttatgtggccgggtagcgactgcccatcgcgttcttcttccacaatcgctctgacccagaagtccccgtcttcatcgacgttaacgccctggatctcatgttcaaaacctgggaattgcttatcgaattcctgcagggcgcgcagatagccaataatgcccttgttaccttgcggcatccgttcgcccggcatcagtacaggaatgcctgggggatatgggacgagcatgctggcggcaattctgccgctaaaatcatccagccggatatgctcggttttgtagcgtacgactttctgataggcttctgccggggtcataactggttccggatcggtgtttaccgcgtcgttgatatgcgacatcagctccagctcatccattttttcatgcattatctgacatagctccttgagggttagcgtgtcgtagtgtggagaatgcgctttcagcgacgggatagcatctgtggccagatcgtcattgtcgtaatgctttttaaaggccagcaggctttcaatcagagttccccatttgcctttggtgatgccgacggagaacaggatcagcacggtgtagtcaccagtacgggcaatttcaatgcgacggtcatcgagaaaacgggtcagcaaatatcccggaataccgtttttctggtattctcccttcgggccgatccctggacaagtcagggtcacttttactggatcgagcatactgttggtttcgaccagatcatcatcggcaaaaccgtgccagcgctcaccggagcgcagcgaccagcagtcggcgctgtggctcagcagcgatacgggtgcctcttcaaaactgtatcgctgcccagaatcgctgtcctgcacttcggttggctgaagcacatcgaagaaccaggcgtcaccaccttcctgctcctggagctggcgcttgacgctgaccacggctttacggaaggcaatcgcttcttcaattgactcctgcacaagcgaataaccggattcaccctccatcatgcttactgccacatcaattgatgcaatgatcgggtagtagggtgaggtcgtgccgtgcatcataaaggcatcgttaaagtcatcgaaattaagcggcgcgcgatcgcttttcttcacatgaatcattgaggccatggagagtgagggcagcattttatgggtggactgtacggcgaatagggttggacgatttggcgtttcctccgcgtccattgcatagcgactctggtatagcggatggaaacgcgcataggcataccatgcttcatcaaaatggatgcgcggtgcgctttcacccaggtgtctgactacatcgttcacgttataacagaagccatcataggtgcagttggttaccacggcgtaggacggggactggctgaccgcaccagatgccagtcggctgtttgccaccagcgcatcaatactggccttcttcaggcgcccggtcgggataggcccaatcagcccccacgcgttgcgggtaggtttcaggtaaaccggccttgcctgagacaaggtcaggccatgattaagtgacttgtggcaatttcggtcaataatggcaatttcatctgcgccaaccgcagcctgggccacaatacggttcgaccccgatgagccggaaacaccgtagaaggtccaatcagagccaaacagtcgggccgcaatttcttccgattttttaggcggtccggcgtggatcagataatcccccatctccgcggtagccacgccaatatcagcgcgcatcatgttttcgccaaagaagttaatgaactcaatgccaacaggatgtttcagataggccattccccccatatgccccgggcagtcccagtaatagtcaccgtcctcggtaaagtccttaagggttttaaagtagggaggaagaagcttatccgcatagcggtggactaaggagtacagtcgattggcagtgaaggctgcggattcagagaacagataaacatattcgctgacctcttttaagacgtcgagtgggatacgatcggtaatattctgttctgagaaaattatcagcggcgtcgtggcatttcttttgcggaatatgctgataaagtgctgtagctcttctgcaaaggtcggattgtctggctcccagtaaaaaccaatcccgctgtattgggggcttttttcgatgatttttaatccatcagagatctggtgcgtgatatgaattttaaaaccgcgttccgcgagttcggtttgaagctcttccagtacctgctgcgaagggttgtcgccatcaagatattgtgaggaaataaataaaagattgtggttaaatttcattaggtgtctccactgttactgttcagatagtatttaactgtgaggatgtcatgcccaagaaacagacattatcgtcaccttaacttgctgtgaattaatctggactaaaaatgtatcgttttataatgcagtagaataaaaacaatgatgtcgaggaccagcagtaaaataaaaaatgccagttcgcgtagcgtaaatattttatctgcgcgatcgtctttttttcttgcccagataaacaggggcacgcccagcgtaagcagcaccggaaccatcgccagatatttgatttcactggcgtagaacataaacaggcagaatacaaagccgataatactgctgaccagcgcggcgctgcggctgtgattcgtggtatagctggcatactcgccgctaatacatagtttaaacaggtatgccgtggtcattaaatacgcaggtaaaacggtcagggtagagatagccagcattgcaagccaggcatcgttagaaaagtagaccagaagtacgacgatttgcataaacgcactgcttatataaagcgaaaccgaggccgaacccttcacattttttttgctgaacggtttcgggaatgtgccgttctgcgcggccaccataggcagttcggcgcagatgatggtccacgccagccagctggtaagcaccgaaatcagcacccccaagataatcataatcttcccccattcaccgacaacaatcttcagaataccggcggtggatggggttggaattgcgctgagctcatgttgagtcagcacgccaaacggcaggatggagaccagcagacagataatcagtgatacaacgaagccaatgaatgtggctttacccacgtcgcgtttatttttggcccgaccggaaagagcgacagccccctcaacgccgatgaagctccagagtgccacgctaagcggtgaagttacctgtgagaaaatagagcctaggtcctgactggccttactcgcgctgtgcccccagacgttatctgcgaacgtggtgtacttcataaacagcatgagaataataataaaggccaccagcgggatcagtttggccagcgtgccgacgatgttaatcgacccggcaatgcgggtaccggagaggactaaaaagttgaatccccatatcagcaaagaggcaccgataacggaaggaatattgttccctcccttgaaatcacctggtaagaaataattcagcgtatccatcaccataatggcaaaggcgacgttgctgaatatagtcatcagccagtagccccaggcgacgttaaatgccgtaaatcggccgaacccttcccgggcatacatataaactcctgactggagatcaggtctaatgtttgacagcacgataaaagttctggagatgaaaaacatgccgataccacagactatccatgctatcgccaccgggcccacggcagaattctccgccatattctgggggagtccgtcaacgccgctgccgatcatcgagctcacgacaatggatgttagcgcaagcaagcccaacttttgtttattatttttttcagtcgaatcgatatgcataagctggctcttattttttttaaatcatagaatctctttgtaaggcttcatgttgtggacactaatttctctgacgatataaattaattataaataaggtcgtcacgataaaattcattatattcctaatttattctatgtatataagaattaacccttgctatatgtaatcaaagtcctacgaatgtaggaaagggtgatgcctctaattgcttgaatctgatgtataatacgggcttttgaggttatctcatggccagcgttaatattcattgtccccgttgtcagtcagctcaggtttaccgccatggtcagaaccctaaaggccgtgacagatttcgctgccgtgactgccaccgtgtgtttcagctcacttatacttatcaagcacgtaagccgggtatgaaagagatgatcactgaaatggcctttaatggtgccggggttcgcgataccgccaggacactgaaaattggtattaacaccatcatccggactttaaaaaactcgcaccaacgcaaataacttcttcgcctgttgcccatgctgatgtggcgcttatctgcgagcttgatgagcaatggagctacgttggcagtaaagcccggctacactggctctggtacgcgtacaacaccaaaacaggcggtgtactggcctacacttttggtccccgaaccgatcaaacgtgccgggagctactggcactgcttacacccttcaacatcggcatactcaccagcgatgactgggacagctatggccgggtggtgccgaagaataagcatctgaccggcaaaatattcatccaacgcattgagcgtaataatctgacgctacgcacccacattaagcggttggctcgtaaacaatctgcttctcacgctcagttgagatccacgaaaaagtgatcggagcatttatcgaaaaacacatattctactaattggatgcactaccgagatttgaatcaaagcgttggtatgcaagggatgtgtcgaactctctagtgggaaaactgcggaagaattgcggggaagtggcggggaaaaacttcactgttgatgctgaacagtctttctggttggctcttgttcgcactatgtacagtgttagtttgattaaactcggtgagtgtgacaaagacggtaatttttgcagttttaggtgaagtctaatgggttaagtgatttcggctatgctcccgacagattaacacgctacatcggtaactatgtcagcgcttggctaacgaagctgaaggtccgctgtgagcgatgagcagaccaactaatctcagcctacttgttttatttcatcagtacgccctgaagcatcgactgcgtatcttgtaggaccgctaacattgatgcctatataattgaagaccgaatctggtttgatataaatcaaaaaagatagatttaacctgatgaaaagaaaagcaattcttgttttctgacaaacactgggatatcagcgttgattattagacgatcggtcaatattgtttattgactactttatagctcaatgacatcaaaccagaaagacgagaaaaaaatgtttaaatccttattaatcagtaagatgtatggtcgccacagtgcccaaattgctgaaatcgctgaaatcgctgaaagcgagctgccacagggggatgtggaggtcaatgtcgactgttcatctatcaactacaaagacgcactggctattacgggccgcgggcctatcgtccggcactttccaatggtgccaggcattgattttgccggtacagtgtccgccagctcacatcctgaatatcagaccggggataaggtcctgctgaccggctggggtgtaggagaaaaacattggggtgggctttccgaaaaagcgcgggtaaagggagactggctgacgccgctcccggcttgggcccattgactgatgaaagatttagtcgttggactatcagtccatgtctttagtgcatcagtaggtatttgaccgccattatcgtcaagctgtttaagtatctggggaacaccttgttcaatatccacgagatgatataaatcagcggtgccatccactccaacacagcgttcaaaaattactagcttagtaataattgcttcatccaaaggcattgctcgtcgcttcgcaatttgagatcgcattttcacaacattcaacaagcgtttaacgatcctgggattaccatgaataattggagagttggctaaaatgggagcaatacggtcagcacgcgcaaacgccagcgcgaggttgctatcatccgcttcaccagtcatttttaaggcctcctgacgtgagattggttcatctttccaggattgctgtaacgccttctctaagccctcacggagcatagttattttttcgccttctaagccatgttcaatggcataaagcatgaacagatacgaacggatctcacggaccccagccttaggcacccgaataggaacctggattagcttatccagataatctatttgatggcgctgtgatgcccctttgaagtaatcagccacagaagagcgaatcatgtcctcatctgctgcaataataaaggctgtattagtcaagaaaaggaatagcctgatagcttcaagtgtatggatagcattggcagggagacagcggtctaggttatctattaccacaatgagtggctttccaagttcttctagaatttccccatattccttacgaaaggcatcaatctgctgaggggggcttttttttgtttgtggtttaatcaaaccacaagcagtttctttaccttctttagctatattgcctaaagcctcatactcttcctggctctggatgccatcggtgatatttcttaatgcaccaatccccctagaaagcaaaccgccagtaggtaatcctgccattaaagctgtaccctcagctagtaatcccatagctctaaaaccatcaactcgactaaggagtctcttagtttttgatataagggctgaattaccttcagcagcttttgtcaattctgtagcgatgacttcaagaagtgcggcacgggtgtcgtcgtacccctgatagagccaagagtcaaaattgataacaatccaatctttgtcgtcttgctcaagtttttgctctatcagttttaacagagaggatttacctgccccccagtttccaaaaattccgatagatactggtaacatatctttcgtggtaagtacatccacggctaactgagatacttcaccaaaatttaggtagtcttctgatgactctttatctgaccacatttttatatcctttacatcaccaatttttacgtcattgagtaaactacaagtttgataaaaccaactctgttcaggtgggcaaattcagtgtaccacttcaccaataatccaatatgatgactgctatagatctattttttaaagaatgaaataagctttcttatcccagtccatattttcctatcagaatccgaagggttaaattcgctcttgtcaaaatcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaacctcagcaaggtttattctattttgatgatctgtcaaatgttctttgttaatttcatctctaattagctgttctttttctatgctgtagtttttgtcattataagtcacatcaaaatcatctaagaaaacgatataaatcaatttaaaacaactagtcttaaataaaaaactatcgcactcatcaggaaaaccaaaaaagaaaacattaagatatttggttgctttgcgcttgtcttttagtccattataatacttatttgcttctgctctttgtttttcatactcactacagaaaaaactctttttactttcatcccattctgaagcatcaatttcaagtttatatgcttgtttggtacctttctttctggctaaaaaagtaaggtaatatctattcgaatttatctccagccgtatattagattgaattttaccaaaataaattgctggcttattatatctaattccttctttatagatgattagttgaaaagtatctttataagttctaactccataagggggaattgataatggttcatagagattatctccattaatgtagtagtctactaccggtttgatgcttgaagatgacacagggtgtactttacctcccaaatctttttcatcatttcgcgtctgtttgataattcttctgccagaagagtcgtaatatctttcagacacatcaagtttcagaagagatatagctaatgccggtggtgaattatgctttttattattctttgagttacacttatttttactcttaggatcatgaatcttacatcccggcctatgagtctctttatatcgaaagtatgattgatttaaatttatttctttgaagctacatggagtagcgggtatcctacatttgtcatacaggcattcaaaagtggttgttcgtatataaagatcatccatttcccgaagatcatgaccatgaacaatttcaccactaacagaatctcttgctattgtcacacaatctcctttgataaaaattaatagattctaatttcataccaaggctaatttaaataaaggctatttaagagaaaaacaagtcagcctgacagacatatcccctcccatggcaatatgccgctatttcgcgttttttttcacgccataatgcgtttcaaggtagcgaatatcttcgattgcccatggtgtgcgcattcttttgggtttattttccattaccatgttttatcagccatcatggctgcctctccggtttgccagcgtgttccacctgataacgattaatcagctgattcagtgccatttcagcctgtttttgctgctgttcactgccattctggttacgggcttcatcatagcgacgtaactgctcttccgccgggatatgccggttaaaagcctgcatgatgccaaacacctccgttctcagttcactgaccgtcatgtattttccccgctgttcatccagacggttcaggcgttcagccagctgctgtaagcgggtcatgccttcattccagcccgtcatcgcctcttccgggagcgcacgactccttacgctcttctgccagttatccaccatttcctgaacatggggattgtcggggaaaagtaccatcagttgctgcagcaactgcgcactgcgctgcaggttatatgccgggggtaattctgtcagtcgcgttatctgctgaccggaaagggttaaccatgatcgaccagacggttctgcaatgtactcatcagcagattaattcctttcgcccccagacagtgcccgaccgccccgttggcgattttttgtaaaggcagccagtgtggtaacgcatcagccccctccagttccgtctgtttaatctgaaaacagggcgtttcaacaggaaaattaatcttacgtgcaaaagagccaggtgcagaaaggcgaacatcaggggctgaaggcatcagttgttgctcaagggcttcctgacgctgctgctgaatgataaatgcttcatctccgctacgccggacatccgctgcctgaagagataaaggcgataataaagcagacatcagtgtcagtgacagcaaggacggacagcgccggaatacgctttgttcctcagccctcacgttcctgcaacataattttccagtcaaacgaaaaaccttttattcatgccataccaacaattaccagcctcctgacgatacctcccaccattttttgcaatggcacgctaccgcctttccggtatttacccacatcaaccggtaccagaatgctgagtaataaatctgccaatttttagctgacttaattttgatcattatagaataatgatctgaactacagcaatatggcagatttatcgatcaatataatacaaatgaacagttctttattctgactaatatcgcaaaaacagcacattacaaaatttataaccataattaatggaaaagtgcagaaaattattccactgaatgcttttaatacagttggttagcttaaaaaatagcaatttttgatttcagtcattgaaaattgcaatgcgtgacgattcaacagcatttaagtgagtttcaggatatgggaaggacatgaaaagaggagcgcaataaaatacacaggaaaaaggggaaaatgtttcgtaaaaacagaaaattaacagcgcacatcaggaaacgcagtctcctgattcagtgctaccacatgaaaatttagttaactgttaccgtactaaaatttatgtcagaagatgttccattaccgaaagtcaatcagcgatacaaagacgatcatggagcactggccaccgtaaccagcgtcgaagaaacccgagtggtttttatgcgggagggttatccgcatccctgtatgcgaccgatgtacaactttctgggaaaattcaaacccgacccccgggaagaaacagaataaaacgaaatccctgccggcaatcacactgcctgatggcagcataatccacttattaattctcatccccggagacaagccctgaaaaccactccgggtgttcattgtatgccgtgttcagcgcatcccaggaaacgttgatataaaagctgtcctgcaatttgcgggtaaccacctctaccacccggttccggttatacgccagtccggcataacctctctctgccagccactcattcagttcatgttccagagacagattgataatatcgtaatcggaccttgccattcccgtttccttagcacatgttttcaggcacggggataaagtataaagaatgtcgtactgctgctgccagagcaatattccccctgatggttgtatcagagatggtatgccggtattttgcgggttgttcccgtcaggttatcgtgcacctccacggtcgttgtcaccaccggcattccgctctgtcttagtctcaggacatcagccgcaatacgctgactgccagaccagaacaggccgtccagtgcggtcaccagtaaccccgcctccagcgcatacttcagccgttcacggggcgctttcacttcccgggcaacctgctgatatggcaatgatgtgttttcattcccaaccacgcgacgaatacggtgagacagatgataccggtatgtatccggcacactggaaagactggccttcaggctgtacacgcagccaaagcgtttatcgttgaacaccgcatttttctggctgatgtcccattcttcacgcagcacagcaatcagttgtggtgtccgggtaagcagaaaggcaattcaaaacaggtgacgtaatccacattcagcagggcaatacgcggccatttttctgatccatttacaatcggatgtgggcgaacattattatcattatctgaaaatctccccctatggcatgtttgccatggcggagagtcattgaagcctttatgaggggtgaatacattcctgaagcagtgcagtggcaaaaaaacaccccgcttttattcattctctgacaataaatattgagtttgactgtatcagattttaggtatttcctagaaaaggacttttttgctcaaggcaaaacaataccgcaaaataatccttcacctgcacaaacatcctcagtccattaaaaaaatcgccatgttaggttaacgacatcaaatttggtcgtttaccatgattaaggtagttacacatggcccgctattatttttcgtgccccaaaatttattttggtgaagaggcaataacctctctatgccaatttaataataaacgagtcggtattgtcaccgatgattttatgatgtcatcaggtaaaactcgttatttaataagtcatatgcctgaggcatcggtatgcattttcggtgaggttactccggatccagatattgatattctgacttccggcgcggcgcgttttaaagcctttaagcccgacgttattatcgccctcggcggcggctcgtcgctggacgctgcgaaaggaattaaagtcacattggaagagtattttggagatcatcaaatcgatctcattgctattcccacaaccagcggatccggctctgaagtgacgtcctacgcgatcatctctgatccgcaaaatggccgcaaatatccgttgatctccgggcaactggtgccggaaatcgccattctcgatcctaacctagtgttaaccgcgccgcgtcatgtcgcggtagataccggcatggacgtgctgacccatgccattgaagcctttgtctctactggctcaaatgactttagcgatgcgctggcggaaaaagccatcgcgttgacctggcgctatctgccgcaggtgtttaacgacgaaaaagacattgcggcgcgcacccacatgcacaatgcctcctgtatggcaggcatggcatttaactccgccgggctggggttggtacacggcatggcacacgccatcggcgggatgctgcatattcctcatggcaaaattaacgccatgctgctgccgattgtcatcgacttcaacagcaaacgggccagcactgaaacccgcgatcgctatcaccgttgcgcgcaaatcataggcattgaccatgcggtaccggagcaggccatcgcgctgatgactcaggagatccgccagatcaatcgccatttctgcatccccgtcactctcagcgaactgggcatcgaccgtgcaaaaatcatcgagttgcgcagcgcactggtgaattcgacgctggccgacggttgtaccgcgtcgaacccgcggcaggtgacgacgcatgatgtcgaagggttgatcgacctgattaccggctagctggataactttgttcagcctccgtgaagcagtcaaaaaagtcctgctgataaacaaaaaccgggcgtcgttactccctatcctgatcgttagacgcccattacccataagataacccaataatcaggtcgtacccattatgaattacaccgaacaacaagccgagtggattacccaacaaattttgcaggaacttgccaccagtaaaaaaacggcagcgcctgctgccgcgcctgtcgcgctgaatattccggtgggcgtgtccaaccgccatgttcatctgtgccgtgaagatatggacattctgtttggctacggctctacgctaacccgttctaaagcgttgaaacagcccggtcagtatgccgccgaagagatggtgacgctgcgcgggccaaaaggcgagctcaacaaagtgcgcgtgttagggccactgcgtaatgccacgcaggtggaaatctctgtggccgacggctttgcgctgggcactaaagctccggtgcgcatgtcgggggatctgctggattcgccgggcattgaaatcatcggtccgaaagggcgggtggtgaaacacaacggcatgattgtcgcctggcgccatatccatatctcgcccgaagaagccgaactgcacggcctgcatgacggaatggaaatcgatgtgcaaacaaacggtccgcgcggtggtgtgctcagccatgtagtggtacgcgtcacggcggatgcagtgctggaactgcatattgatatggaagaagctaacggcgtcggtctgcgtaatggcgataccgttcgcggcataaaacaggctgcgcgccatggctaacagccccgaaaactgccgatttcacgaattggccgcgctgattgacagcggcgaatgtcggccctactccggcgcgttgaaggtgggggggatctcggtaccgccaatatcgcaatcgtggtgctggatgaagataaccagccggtggcaggggtaatgtatccctccaatgtggtgaaagacggcgtggtggtggattacctgaccgccagccgggtagtagcacgtctcaaacaaattcttgaacagaaacagggctgcacgctggagcgcgcggcgatcgcagtcccaccggggatctctgaaggcaacacaaaagtgatcgtcaacgtagtggagttggcgggttttatcgtgacccaagtactagatgaaccggtagccgctgccagcgcgctgaatattaaaaacggggcggtggtggatgtcggaggaggcaccaccggcatgagcattttgaaaagcggtaaagtgacgttcagtgccgatgagcccaccggtggaagccatatgaagttggtgatcgctggcgcgctgggcttgccttatgccgaggcggaagaaatgaaaaaaaacgggcaggaagcgcaggtctttaccctggtgctaccggtggcccagaaaatggccagcttggtgtcgggatggttcgctacccagcaggtaaaaaatatttatttggtaggtggcgcgagcagcttcagccagtttgccaacgtgttcagtaaacaaaccggtaaaaatgtgattccttcggcagagccactattggtcacaccattaggcatcgccatgaatgcggaccaggggtaaatcaatggacaatcaaaccttatcgcaactgctggaccgggtcatcgctgaagtgttggcacaatccgtcgcgcagaaaaatgtctgcgtagtggtgactggtgaggatatctcctcgctgccggaaacgctgaactgccttgaggcgcttgagctggcgggttatcagttgtgggtaaatttttctcacagcgccagccagtcggcgctgaaatctgtctgcatggatgcgctaattcagcgtggttctcgtgctggatttgacagatcgccgcctcactatgaggtgctctatctgcctgcgctctctgtcaacagcatgagcaaaattgcgctgggcattcgcgataatctggcctgtgaaactgtatttcaggcgttacagcaccgtaaacagattatcgccacgctgcatcaacaatgcgtcgatagcgaattaccgatgccactgctgtcttgtctggaaggttacgctcaggtcctagagagctatggcattacgcttttcggtaaacgtgcaacccatgtcaagtcggtgcaaggaagccaatccaccctgacagtagccggtaaaaaacgtttaatcacccagagcgatatccgcctactgaccattggcacagtgctgcgcattgagagcgacacgctgattacccctgctgccagagatgaaatccagcggcgtaatctcactgttatccatggttaaccggaggaaatatgtacctcgctaaagttactggcgcattggtttccaccactaaacacgcctcgctgaatggctcaaaactgctgatagtggcgcggctcgatgaaaactatcagccgactgtccatgcccaggtggcagttgatactgtcggcgcgggcaatggagagattgtgatcatcaccaccggcagttcggcgcgtatgagcaacaacaaagatcactcggtgattgacgctgccgtggtgggtatcgtcgactcgctcgaacttaacggttaatagcggcgcgtacgctgaggaatacttatgtctgcgaatgaggcttcactcgacaactggattaacgaggctattgccacgcagttaccggaactccggatgtcgctgagcctggaggacagtgaactgctggcaaagttggtccgggaaatagcacagtccagcaatgtatcgatcgtttttagcctagtggatgcctgcggtcagcagcgttttttcttcagcatggataacgccctgctggtcagccataccttggcaccacaaaaggcctggaccgcggtagctctcaaaatgccaactcacgaactggcaacgctggtacagccgggtggtgatttgtacggccttgagaaagaaaaagatatctgctgcttcggcggtggttttccctgctggtcgggcaggcgcttactaggcggcatcggcatcagcggcggcagtgttgaggaagatatgctcatcgcccgccaggcgatggcgcagtttagcgttctgcgttatcccctcacaacaacccgttaattttttgcagtccatttcagggggcatcatgtctttagcttgtgtattagtgattaattgtggttcctcatcaatgaaattctccgtcattcctcaggatgcagatcagccgttgctgtcgggcctagcggaacgactgggtattgatcatgctgtcataacgtttaaagaccgagacggccataaatccactgtcgcgctggatgacgccagccatcagcatgcgctcaaagtgctcttcgcgaagctcgacgaacagcaactgttggaagccatcaacgccgttgggcaccgcgtggctcatggcggcagcgacttcaaaagatcagtactggttaccgatgatgtgatcgaaaaagtccgcgcgctgtcggtgctggcccctttgcataaccctgccaacctgattggtattgaagcggctcgggctctgttgcccgcgttgccgcatattgcggtgttcgatactgcgttccaccagaccttgtctccggctgcttacacctatgcgatcccgctggagttccagcaagattatatggtgcgacgttacggctttcacggaacatctcaccgctatattgccgccgaggcgcttgcatcactagatctcgacccggcggatcatggcatcgtgattgcccacttgggcaacggttcatcgctatgtgcggtgcaaaacggcacgagcattgacacctcaatgggtatgaccccgctggaagggctggtaatgggcacgcgctgcggggatcttgattttggtgtcgtcgcatatctggcgaaacgcacaggtcaaacgttcgacacgctgtacaaaatgctcaataaccagtccggcctaatggggatttccggcttatccagcgattgccgcacccttcagcaggcgcgtgatgagggccacgaacgggcagcgttagccatcgacgtgttagtacatcgtctcgcacgacatatcggcggccacgtgacctcgcttaaacgcttcgatgcgctgattttcaccggtggaattggcgaaaactcggcgttaattcgagaacttaccgtgcaacgccttcaggcgctgggattggaactggataaagaacgtaaccagcagctgttcggcggacgtagcggactgatttctaaaaccgacaccacgaagattgcggtcatcccaaccaatgaagaaaaaatgattgctatagatgcagcggagattgcccgcacggcataactaattggcaaaaatacgacagttttaacagtaattatgattgctattcagagcggggctattttgcaaggaagtttaaacgcagatcttttattacaaacctcgggtggattttattgtcaattgcgggaatgcaaaagcaagatagtcccactgacgcgcaaaacattttgtctgaataaccttagcattatgataattaaataattaatgcacatgggtgaatccgtagattgctattcctctgtgcacgttttctttctatcggaaatattgaggtcgttatgcaacaagaagcattaggaatggttgaaacgaaaggtctggtttctgcaattgaagctgcagataccatggtgaaatctgccaacgtgaccctagtgggttatgaaaaaatcggctccggcttggtgactgtgatggttcgcggcgacgttggcgcagtgaaagccgcgacagatgcgggctccgctgctgcgagtaaagtgggagaactggtctccgtacatgttattccacgcccacacattgaggtggaaaaaattctaccgaaggctatcggttaataacaataaaggatactgatcatgagagataatcttgttgagcagattatatctgacgtaatgaataaacaaaccgatatctcaccggaagctaaaacagcagcaaatttcgctggttgcggtattacggaatttgtcggcactgcgttgggccacactatcggcctagtgattgccaatgttgataatcaattgcatgaagtcatgaatatcgacaagaaatatcgctctatcggtattcttggcgcacgtactggcgcaggcccgcaaatttttgcggctgacgaagcgattaaagcaaccaacagcgaaattatttctattgagctggcccgcgataccgaaggaggtggcggacacggttgcttaattatttttggtgcgtctgatgtttccgacgtcaggcgtgcggttgaagtggcgctgtctgaaattgaacgcaccatgggtgacgtttatggctcgtcagccggacatcttgaattccagtacaccgctcgtgccagctacgcgctgaataaagcgctgggtgcgccgattggtaaatccttcgggatgacctgtgcctcgcctgcggcgattggcctagtgattgccgacgctgcggcgaaatccgccgtgattgacccggtgggttatgccagcccgtcgcaaggcaccagttttagtaacgaagtgatcttcaccttctccggtgattccggtgcagtacgtcaggcggtgattgccgcgcgtgaagtcggtctacaactgctctccacgttagatccggtggaaattaaatccaccacgacgccatatatctaagcatctgatgacgatgcacgcggcgcggtcggtagatgaagagtagtaaggaatttaaagatgaatgatattgaaatcgctcaggctgtctcgaccatcctgagcaaattcaccaaagcaacaccggatgaagctcccgccacgtcagaagcagcgcgggtcgacgggttggatgaaattgtcgctaaggcgttggcgcagcactcttccgtgcgcgacgccagtgcgatctctcaggtagcgaaggtagcgaaggtagcgaatgctagcactggagcattcgataccatggatgaggcgatttccgccgccgtcttggcacaggtacagtatcgccactgttctatgcaagaccgcgcctcgtttatcaatggcattcgcgatgtcttcctgcaggaagatgtgctgtgtgccctttcccgtatggcggtggaagagaccggcatggggaattacgaggacaaactgatcaaaaaccgcgtcgcagcgctgaaaacgccaggtatcgaagatctgaccaccagcgcggtttccggagacgggggtttaacgttgatcgaatactctgcgttcggagtgattggttcgattacaccaacgactaacccgaccgaaaccattatcaacaacagcataggcatgctggcggcaggcaacactgtggtgttcagtccacatccgcgctcgcgcaaagtgtcgctgtacgcggttgagctgatcaacaacaagcttgcccagttgggcgcaccggcgaacatggtggtaacggtgaccaaaccgtccatcgacaataccaacgtcctgatcaacgacccacgtatcaacatgctggtagcgactggcggtccagccatcgtgaaaaccgtgatgtcatcaggtaaaaaagcgattggtgcaggcgcaggtaacccgccagctgtggtagatgaaacggcggatatcgaaaaagcagcccgcgacatcattaagggctgtagcttcgacaacaacctgccgtgcgtggcggaaaaagaggtgattgttgtgaaccaggtagcggactatctgattcactgcatgaagaaaagcggtgcctatctgttgtgcgataagaagttaagtcaacaactgcaatcgttggtgcttaatgaaaaaggcactgggccgaataccgcctttgtcggcaaagatgcgcgctatatcctgcaacaactgggaatccaggttggcgacgatatcaaagtcatcttaattgaggctgagaaaacacatccgtttgtggtgcatgagctgatgatgccggtcctgccggtggtgcgcgtagacaatgttgatgaagccattgagctggcggtgaaagtggagcacggcaatcgtcataccgcggttatgcactccaccaacgtcgaaaagctgaccaaaatggcgcgcctgatccagaccaccatctttgttaaaaatggtccctcttatgcagggctgggggtgggcggtgaagggcatgccacctttacgattgccggaccgaccggcgagggacttacgtcagcgcgttcgtttgcacgccgtcgtcgctgtgtaatggttgaagcgctgaatattcgctaactatcgcgaagggtgacttaaagatgaaaaaacgaatcataaacgcaccgaccccggatattttggctatgttgaaacggcgtatgcccggggagtttcgttcgcgtttggatttgattcgcatcgacgccattggtttgttaatactgccggttccggatctctatttttatgccgacgtagccagtaaaagcgccaatgtggtggtatcagaaatctttggcagttgccctcagcatatcaccacattggccatttttggcgaagtcgcggcggtgcatgaagccatgcgaatcattgaggaagacgataaccagttttgagagtccgcttatgaagaagatattacttatcacaggcgatttctctgaagactatgaagtcatggtgccatggcaggcattaaacatgttaggtttcagagtggatgtagtgtgtccgggaaaacgtaccggcgagtttattaaaaccgcgattcatgattttgaaggtgatcagacctacaccgaaaaacccgggcatctttttagattaactgcatcatttgatgacataaggttacaggaatatagtggtgtttatatttctggtgggcgttcatcggaatacttgcgattaaataagtcagtattggatatcgtgcattacgcgatgaatttaacattacctgttgctgcaatttgtcatggcccacaaattctggccgctgcaggggtattaaaaggccggaaactgacgggatattttacggtaaaaccggaagtggaaatggcgggtggccagtgggtcactgccgcagatgatgaagccattgtggatggtaatttaataaccgcgactacctggatggggcatccagcaatattacgtcactttattactcaaatgggcactagcattattcattaataccctggcatctccgcaaggttaacaaaatatattcgggagttttatatgttagagaaaggcttttctaatccgacagaccgtgttgtaagactgagaaatatgatcctgacggcgaagccgtatgtggaatcagaacgcgcggtgttagcaaccgaagcatataaagaaacagaacaactgcccgcgattatgcgtcgtgctaaagtggtggaaaaaatctttaaccaattaccggtaacaattcgcccagacgaattaatcgttggagcggtaactattaatcctcgctcaactgaaatctgccctgagttctcctacgactgggtggaaaaagagtttgagactatggaacaccgtattgccgacccgtttgttatcccgaaaaagactgctcaggagcttcatgaagcatttaaatactggccgggtaaaactaccagtgctctggcggcatcttacatgtcagaaggcactaaagagagtatggcgagcggtgtattcactgttggtaactacttcttcgggggcgtcggtcatgtcagtgttgactacggtaaagtgctgaaaattggtttccgtggtatcattaatgaagttagccgtgccttggaatcattagatcgcactgaaccaggatatataaagaaagaacagttctataatgcggtgctgatcagttataacgcagcgatccgtttcgcccatcgttacgctgaagaagcatcccgtctggcgcagcaggagagcaatccgacccgtaaacgcgaactggagcagattgctcaaaactgtactcgcgtgccggaatacggtgctaccacattctgggaagcatgccagacattctggtttattcagagcatgttacagattgaatccagcggtcattctatctccccggggcgtttcgaccagtatatgtacccgtatctggagtcggacaaatctatctcgcgtgaattcgcgcaggaactggtggattgctgctggatcaagcttaacgacattaacaaaacgcgtgacgaagtctctgcccaggcgtttgccggttacgcagtgttccagaacctgtgctgtggcggccagacagaagacggtcgcgacgcaactaacgatctgagctacatgtgtatggaagcgactgcccatgtgcgtctgccgcagccatccttctcaatccgcgtatggcagggtactccggatgagtttctgtatcgcgcttgcgagctggtgcgtatgggcctgggcgttccggcaatgtacaacgatgaagtaatcatcccggcgctgcagaaccgtggcatttcgctgcgtgatgcgcgtgattactgtatcatcggctgcgtagagccgcaggcaccgcatcgcaccgagggctggcatgacgccgcgttctttaacgttgcaaaagtgctggaaatcaccctgaacaacggtcgcgttggcaataaacagctaggcccagtgactggcgaactgactcagttcaccagcatggaggacttctacaccgcgttccagaaacagatggcgcacttcgttcatcaactggttgaagcctgtaacagcgtggatattgcccacggcgaacgctgcccgctgccgttcctatcagcactggtcgacgactgtatcggccgtggtaaatctctccaggaaggcggggcgatttacaactttactgggccgcaagcattcggcgtagccgataccggcgactccgtctatgccatccagaaacaggtattcgaagatcgtaaactgtctttgagcgaactgaaaagcgcactggacgccaacttcggttatccggtgggtgcgaacccgcacactccagcggcgaaatcctcgctcaacgagcaggatatctacgatgtggtgaaacgcatcattgaacagcatggcgcgctggatccggcagcgattaaaaacgaagtttatcgccagctgacttccggcagtgcagcaccggtgcaatccggcactatgtcccgtcacgaggagatccgtcgtattctggaaaacacaccgtgcttcggtaacgacatcgatgacgtggatttagtagcgcgtaaatgtgcgctgatctactgccaggaagttgagaaatataccaacccgcgcggtggccagttccaggctggtatctatccggtgtctgcgaacgtgctgtttggtaaagacgttgccgcactgccggatggccgtctggcgaaagagccgttggcggatggcgtatctccacgtcagggtaaagacacccttggcccaaccgccgcagccaactcagttgccaaactggatcactttatcgcctccaacggtacgctctataatcagaaattcctgccgtcttctttggctggcgagaacggtctgcgcaacttcagcggcctgatacgtcactacttcgataagaaagggatgcacgttcaatttaacgttatcgaccgcaacactttgatcgaagcccagaaaaatcctgagcaacatcaggatctggtggtacgcgttgcgggctatagcgcccagtgggtagttttagcgaaagaagttcaggacgacataatcagccgtactgagcaacaactgtcgtaaataccagacgggctatgtatcaatatatagcccgttactttctccacgacttctggttgttacttttatctgaaaaggtaattcatctggtaaatatagagtgatgttatgaataaagttgagtacgaaaccgaaggcgtcatatttaatattcaacgctattctttgcatgatggtccaggcattcgaaccattcctttttttaaaggctgcccgctgtcctgcaaatggtgtagtaatcctgaatcacaacgtcacagcccagagttattatttaaaaagaatgattgcatccgctgtggaaaatgtattgatgcttgcccacaacaggctctttccactactaatgcctggtttatcaatcgcgaccgctgtattcagtgtgggaaatgtactgagatttgccctacccgtgcgctggaaatgaagggcaagcgtatgtcggtaacggcagtgatgcgcgaactggaaaaagaagagaatttataccggcgttcaggcggcgggattaccctgtccggtggtgaaccgctggcgcagccggaatttgcccgcgagctgcttaaagcctgtaaagccaaaggctggcacaccgctattgaaacaagcggcttcaccaccaaagcggtgattgatgaggtatttccctatgtcgatcttgctctgaccgatattaaagccatcgatccggaaatccatgagcgcaacaccggcgtgaataacagagtgattctggagaatctgctgcgcatctcctttttaaccaaagtggttgtgcgtattcctgtgatcccaggagtgaatgacaattcgcaggaaatccataatattgcggagttcgcccgcctgatgcagaacgtcgataccattcacttattgccttatcacagcttcggtgaaaataaatataatctgcttggtcgccagtatccgatgggcgatacaaaaagtatcgaagaagcccaaatggcagagttaaaagcaatggttgaatccttaggttttaactgccatatcggcggttaataaaagatgtaataagagtgcgaaaaaatgctgcgcttgtttatttgttacgcatgaatactatttcaattttaaaaatatagagcaatctgcattacttatattgtcatttgatttaattacagaggtaagctagatgaatagcttagatattgtagttgccttcggcggcggcatatttggtgcggctgttggcgcgctggcggcgtttgaattcgttgggcttctggttatcgccatgacggtagtgcaaattattaccggagcatcatcggactttattacttttccgtttggactgtttggcccgcacaccggcggctttgccgctggggttgcggcgacggcgtatgcagcgaagaaaggcaagctgggttccgggcgtgatatcactgccgggttgagcggtctggcggcttacgatgtgctgctggtaggcggggtttttggggcggttggttacatcatcgcctgggggttgaaccagattccggccttcccgtccggcaatgcttggaccgataccgtggcactaaccgtggtgatttctggcgtggtctcgcgtctggttttcggtaaaactggcctgtttggaaaaccggagcagggaattcgtcactgctatccgccgcaggataagtgctggataccttaccatagccgcattccgcagctttccgtgctgggcttgggtattggcttgatggcaggctttttaggcctgaagtttggcggcaacggcgcgctgctggcgtttggtatttccgcgttctcactgattttcctgcatttcaatactcaggtaccggtgtcacatcatatttcgctgcctgccgcgttggtagcggtgccatcaggtagcctgatttgggctgctatcgttggcataatttgcgcgatattgggtgaactgatgtcgcgtatcttcctgatccacggcgatacacatattgacccgccggcgatggtcatcaccattatgaccacgatgattaatctgttggcgaccattggattatttaccttggttcccctgttttaatcccgccataacaaaaagccagcagtgtctgcctgctggctttttgttatgtgcgccgtgactggcgctgttcttcaactgtggtggcagaagaacgactaagaggtgaaagtcctccacacacccggtgaggggaagtgttagcggaaggcaagggtgttcatcgcgaggtgaaatctgaaggaagctggatgcaaaatgctggcctgacgaacaggaagcggttaaggcggcgcagcagggtaaggtggcactaatcaccaaagcccgatactcacacggaacgctgtgacgtaaagccgacaggcataagcaggaaagtcgcgtgaattaccccgggagatctgtcgccctgccagtgtgctaccggcgccgtgaggcgccgggatggggcggcagaagtcagccgacgccgtagtagtgctgcaaaaccggcagcatgaagggccgaacatgattaactgtgattaggacatccgaacccgatgatgattaatgaagcacaagcgcaggccactgcgaccagcggcagaggagacggacagtatccgtcagggctgcatgatggcgctgaaatcagcacggcggcgggtgggcaaacgaaagcggaagtgccgctgacgatggaagcggtgataacgagagaaaacctgatgctggcttatcagcgcgtggtggaaaacaaaggcacggcgggggtggataacctcagcgtggcggagttgaaaccgtggctgaagaagaactggcgcagcgtcaggcaggcattgattgacggaaactaccagccgcggacaatacgccggatggatatcccgaagccggatggcggcgtgagaacctcaggcatcccgacggtggtggacaggcttatccagcaggcggtgcaacaggcacagcgttacatacggggtggcaaacggtgggtggtggatatggatctggagaagttcttcgaccgggtggatcacagactcctgatgacgcgtctggccagaacgataaaggacaggcgggtgctgtgactgatacgccgctacctgaaagcggaaatggttaaagacgggcaaagggagaaacggcaggcgggcatgctgcagggcggcccactgtcgccgttactgtcgaacatcctgctggatgaactggataaagaactggagcgtcgtggacacagcttctgccgctacgcagacgactgcaacatctacgtaagcagccggaaagcgggcgaccatctgctgaagaacatcagggcgttcgtggagaacaaactgaaggtgaatgagaagaagagcgcggtggcgcgcccgtgggatcggaagttcctcgggtacagtgtgacatggcacaaacaggcgaagctgaagatagccctgacgagcgtgaacaggctgaaggagaaagtccacagtctgacgacgggaaaccggagcaaatcagtgaaagcgacaatcaatgctctgacaccagtgctgtgtggatggataagctacttcaggctgacggaagtcagaggagtgctggaggagctggatggctggatcaaacggaaactgcgttgcttgttgtagcggcagtggaagagaccgctaacccgggcaaagaacctgcaaagagcaggactgagtaaggacagggcaatgatctctgcgtacaacaaccacgggccatggtggaactcagggtcaagccatatgaatcaggcgataaagaatacatggttcaggaggcagggtctgatatcactgctggaacagtagaggcagttccagagttaacatgaaccgccgtatgcggaaccgcacgtacggtggtgtgagaggacggcgggagtgatcccgcctcctactcgatcaattttaaaacacctcctatgtaggtggtgatcgttcatgtggggctttctgacagactgcctcgtcattccattcgtatcgccagtaactggcgtttgtattgtggcagttctggtatacgtttccctgtgtatctgcactggttcagcaaggtttgaaaaggagtatcccttgcaaataaccgaagcattactttcagagccggagctgtttttgttgctgtgatccatttcaattttttcgcgacaaattatttataaatatatgattatgtttttaaaaatgcaggctgaaagtatgaagaataaatacaaattaaatgagtttttggatgtaaaacgccttcagaccctgcaggacaacttttcaaaatcaatgatgatcgcgctcgtggttgtggatgagaatggtatcccggtcactaagcccagcggtttttcagacttctgcatgcgttcgcgtctcaacccgacactggcgcaccactgttatgaaagcgacaacgctggtggccgtgccgcgatgcacgctcgcaaaccggtggtttatcgctgccactgcggttttgtcgaattcgctgtcccaatcatgattaacgatcattatctcggtgcttttatttccggtcaggtaaaagtcgaagaagagaaagaacagagcatttcctatattctgaataataatgacgtctggaaagataatccttggttaattaatttgcaccagaatacacgtcgcatgccgtatgagcgttttgagtctactgcctcgacgttactacacgtatcgtcttatctggtcgaacaagcgcacaccaataatatccaacgcgaacttcgtaaaaaggatcttgcactggctaatgagttaagaaaacgtgtagagatagaacgctcactacatgaagctgaatttaaagcgctctcttatcagataaatccacactttttatttaacgtattaaataccattggccggttagcttttcttgaagatgcgcagcgtaccgaaacaatggtgcacgatttctctgacatgatgcgctatttgttacgtaaaaatagtcacggcctgattactctgcgtaatgaaataaattacgtcaacaactatatgtcgatccaaaaagtgcgtatgagagaccgtttcgattacctgtgcgatatcccggaaaaatatctggatgtagtctgcccgtttttgatcctgcaaccgctggtggaaaacttctttaactacgtagtggagccaagggatagcaatagtcatctgctgatccgtgccacggacgatggcctgaacgtgattattgaagtcactgacaatggcgacggcatcgcaccagataccattaatcgcattttatcaggcgaccaaaaattgcaaaaaggcagtattggcattaacaacataaaaaatagattgaagttgttatttggcgagagctatggcttggaaataatgagccctaacaaacccaggatgggtacaaccattaaacttcggttcccaatgcaggaagcctgatacaggaaaaggacatatgtttaccattgttatcgttgaagatgagcccatcgaattagaatccctgcggcagattatctcccagtgtgtggaaaacgctgcgatccatgaagcctcaaccggtaaaaaagcgattcacttaattgaccaactgagtcaaatcgatatgatcttagtggacattaatattccgttgccgaacggtaaacaggtgattgaatatctgaagaaaaaaaacagcgatactaaaatcatcgtaatcacggccaatgatgactttgatatagtacgcagcatgtacaaccttaaagtggatgattatctgctcaaaccagtgaaaaaatgtatcttgaccgacaccatcaaaaaaaccctagcattcgacgaaggagaaaatgaaaaatcccgcgccctaaaacagaaagtgttcgccatgatagacgattgcgattacacccagtggcacaactttatttttgacacgctcaacggtgcctgtccggtggatatgatagaagaggataagcgcaaagacgtgatcgattttctggaaatagttagccagtatatgaccgccaaaggggaaaagttaatgccgactaaccgtaaagtcgccgcgctgatcaaagacatcaaccagtatggcatgatggaaagccgctatttccgcatcatgatcagcctgctgaccattagcgaagagctgtttgattacgcattaaaaggctatacaggcaatatcgattttatcgaacgagcgaaattccatattgagaaaaatattctcagaaacttgacgctcgatgacgtggcagcaaaatcgtttgtcagtgcctgctatttgagccgtacctttaagaaaattaccgggttcgggttttcgaactatattgccacgcgtaaaattactatcgccaaatcgttattgcggttcagtgacttacaagtaaataccattgcgctggaactggcataccaggattcaaactatttttgccgcatcttcaaaaaagatactggcatgaccccctctgattatcgaaaagtcgtgtccccgggaattacacggtgatggcgtgattttgcattggcccgataatgaaagcaaaatagtccaacacgcccgcaagatagtttacgcccacttgtcaggttcctatcctaagataggaataaacttcccaaacaagtgggctcgctttgaacgattacctgtttacctccgaatccgttgccgaagggcatcccgataaaatggcggaccaaatttctgatgccattttggatgcgatactcctacaggacccgtggggtaaggttgcctgtgaatgcttggtgaaaactggtgccactattgttgccggagaaatatctacccatgccgccgtggatattgagaagattgtccgcaacaccataaaagagattggttacgaccattcgcgattggggtttgatggcaatacctgctgtgtattaaatatccttggcaaacagtccgccaatattgctgacggcattcgcggccactcgatggaagaactgggggcgggcgatcagggcatcaccttcggttacgcctgtgatgaaacgtcggaactgatgcccgccacgctggtatacgcccatcgtctgatggagcgccaggcgcagttgcgtaaatcccaacggttaccatttttactccctgatgccaaaagccaggttaccctgcgctatcaggataatcgtgttcattcagtagataccgttgtggtgtctacccaacacagccctgacgtttctctggacgcgctacgggaagcggtcatcgaagaaattgttaaacctgtgatgccttcgcactggctcacaccacaaacccgctttctggtgaaccctgcaggcagttttgtgattggcgggccggtgggtgactgcgggctaacggggcgtaaaattattgttgatacctatggcggcgcggcttgccatggcggcggcgcgttttcaggcaaagatccgtcgaaagtcgatcgttccgccgcctacgctgctcgctatgtggcgaaaaacatcgtcgccgctgggcttgcctcacgctgtgaagtccagttgggatgggccatcggcctgccccgccctgtttccgtcaggattaacaccttcggtacacaaacagtgtcatctgaagcgttgctgagaggcgttaacagccatttcgatcttagcgtgttcggcatcattactacgcttgatctgctggtcccccgctatcgtaaaacagcctgctatggtcactttggtcgcgacagctttccgtgggaagttacggacaaagcggcgctattatacgaagacgttggacgttaagccgacgacgcgcagcacagttgaatttattacaggagaaatttatgtctgggaaaagtttaggcttaatcgaaaccgtcgggatgtctgcggcggtagaagccgccgatgccgcaatgaaatccgctaacgttagtctggtaggctatgaattgacgaaaggcggcgggatggtgaccgtgaagctggaaggggaagtgggcgcaattaacgcggcggtagcggcagccatcagcgcggcaagccgggttggcgaggtgtatgcccataaggtgatcgcccgcaccgcgcagcatatcgagcagattattcactctaaagtgaccgccggcgtcgcagaacctcaacctgaagtgcctgctgcacaaccgacactgcaggctgaaaacgcgccttcacagacattcccggtggttaaccttgatacgtcaatcagcgcatcctgtatggatgtcactgatgaaacgctgaagtccgtggagcagcatcaaccagttaaaccctcaatagaaaacactaaacctacaaaatctgatgtaccgcaggaggcagcaaagaaaggtcctcgttccagcggcaagaaaaaataagtaaattgctatgacgctgccgcggtaacaatttctttatcgcggcatttttttgcttaacagataaagtaaaaaaccatctgcatagcgggcggctttgacacggccccctgaaagggggcttaaacactaccctttcaggcccagttgtatttgtctttcttcttcctcttttgctaccttgttcgaaaagggacgctcgtcctcgcccactgttctgtatgcatacctgctcccactgcaaattatattgctgggctatgttaacaagcctatatgctattaaaaactcatgagcaacatattgataatatcattcttatatatccacgcttaagtaaataacgcttacataactaactattccatctcacttcttccttagcgagttttcggtatgcaataggagctataccaaagcggcgagtaaatgcccttgtaaatgtctgctgaaaatcaaactgatatttaaaagtgatagtcgtgaccgattcagtagtagaacgtagttcttctgctgcatttattaatatacctaccaatagaaataccaatgatatgtttaaacaatctctgtaaataccattttgaatatccagctttttttgcctcaatatttattgagagttctacctcaagattttcatcaatccatttagcaaactcattgatatcagagctgttttttatagtagcgttcatttttatcgatgcctgtgaaggttgattgggtcaactccagtactatgcaaccctctctgaaaagggatttatcatcaggttgcagaatgcaacttcgccccccccgtaaacaaagaaaaaagcaggaacgccagagtctcactacgaatttccaaacatatttctctatataacttacctttttcgaaaatataacatagtaattttacaaaattattgacatccaccattttttgtaagaaatttattcttatatcatccggacattcttcacaaaaaaaacacaatataaattacattccgtaagtgtacattatattgtaatttaatcaggctacgtgataagcaacgatacatcgctttaaccggttcagaaactctcccatttttgatggctgtaagctcatcaaataatgatagtggtacccgctcgatgacttgtcgcagaagatcttttttttcgttgaaataccagtatatggccccccgagtacaacctgcgcgcgccgcaatcatctccagtgtcgtcttcgaaaagcccgtctcacaaaagcagaactctgccacatccaggatttgtttgcgggtttcttccgctgcaaattttgtgtgccgcaccactgttgaaatctccattgacatcttatttcaggaaatatctctggggcatttagtaccaacccaacagccatttactcaggcgcagtatgttgtttactgcacctgaatatttactcatgcttatgattgctcagcttcagtcttatccgatgatttcttatttctgcggctgaagaacccggcaattaacatatagaagagaggaatataaaagattgccagtatcgtagcagtgatcatccctccaaccacaccagtaccgatggcatgtttacttccggaacttgctccagtcgagacagccagtgggataacccccattacaaatgccagcgaagtcataattatcggtcttaacctcactctcgccgcttcaacagcagcctctttaatgcttagtccttctttctcatgcaattcacgagcaaactccacgataagtatggcatttttcgcagacagccctattgttgttaataaaccgacctggaaaaagacatcgttaccaaggccgcgcaacaaagtagcacagacagcccccaggacaccaagcggaacaaccagcatgaccgagaaaggaatgctccagctttcatacagtgcagccagacacagaaagacgatcaacagtgaaagtgcatatagtgcaggagcctgagaacctgaaagtcgttcctcaaaagacaaacctgtccaggaaatatggaaaccttcgggaagtcttgccgcaatatcctcaattgctttcattgcatccccggaactgtatcctggtgccggttcccccaggatttcgacagcagagataccattatattgctccagttttggtgagccataaatccatttgcctgttgcaaaagaggcaaaggaaaccatgtcgccatcactgttacggacataccatttatcaaaatcctgcggtgatatacgtgagccgggttcgccctgaatatagacttttttcacccgtccacgatcgttaaaatcatttacatacatcgaaccccaggctgctgacattatgttgtcgacgtcgctcatgctcagtttaaacgcctgaactttctcgtcatcaatcagaatctggaactgaggctcatcgttcatgccgttaggacgaaccatgtttaacgctggacttttcgccgcttcagcaagaagctgatttcgggcctggatcattttttcatggctagctccgctacgatcctcgaggaacaggtcaaaccctgtagcattccccagttctgatacggcagggggcgctttaaaactagactagcccccagaatctccagacaaccaatatcacttatttaagtgatagtcttaatactagtttttagaccagtcattggagaacagatgattgatgtcttaggaccggagaaacgcagacggcgtactacacaggaaaagatcgctattgttcagcagagctttgaaccgggaatgacggtctcccttgttgcccggcaacacggtgtggcagccagccagttatttctctggcgcaagcaataccaggagggaagtcttactgctgtggccgcaggagaacaggtcgttcctgcctctgaacttgctgctgccatgaagcagattaaagaactccagcgcctgctgaacaaaacgccggatgtctcccggctctgaaattaaggcttcggttatttgcacgaaatgttccttttcaaaccctgttgaattttgttaagccggtgcagacacacggaaaacgcacatcaacaccggacggtacgatacaaacaccagtgactggcgggacgaagggaatgacgaatcagtcaggaaatgatgacaaacagttggcagaccagaggagtcagcagaaagatgagcgggagtgtcgccagcatcggggacagggctgatttccgcaatgccggcgctggtattgcaacacgtttcatgctgctgctcctcgtgattcctcaattcgctgctgcatccactgctccacttcacttttgtaccagcggctgctgcgccccagtttgatgggtttagggaaatgaccttcactgatcagcttgtaaaaccatttatcggtcataccggtgaaactggtgatgtagttcatgtcgatcaggggatcgtcggcacgcagtaacacgctgtcgtggcttgttgtggtcaacatggtcagaatgtcctttgtgagatttatgaagtttgtgcgaatgcagggaaagatgctgaaccgagctttcagaacggtcctgcagatccgggatagccgggattaccggcgaggcaacgggcttccggatcgcacacaccacgacgatcgcgggcgaaatcactgaacgcccatatcaactctttgaggatgttttcacagtccggtgaacgactgtccagcaccacatcccgggtgatctgcttctgatactgctttgcttcacccggtgacgcgaagcccagtacgttactccaggcatccagtatcaaccggtccaattcagggccatcgaaatactcctgtctgacgcacagcaccacgtggtattccggtttttcaggatgacgggtcaggagccagcagagatcacgtccgggggttgcattcatcagcgcactgacggtttcgataaaatccataccaaaccaggtcgttctgctgttgaaggtattgtcatattcacacggcagacgaagcaggatccgccgtatccgtgagccggactgctcacgcagcgcacgctcaaggacgccgacgactttgttctgataagatggccagaagggggccaggctatagtcgaaataagggatagcattcataagatatgctccgttatgcgcagcccacaatgcgtcctgcccgtgaataagctgacgtgttatggtttgcggatggggttgatggaataagtgaagaaccgaagcagaacgggaagataagggaaagaacactggatgcaggttcagggggaatgatctccgttgacttcggttcacatcattaatcatcccggtaagtttttaccgacggagtgtttccaggagcggaagcagataaaaataccgtttcatgacttcagggctattagcagaaaacgatctaagggcgttggctgacgcccttaccgtgacatacactctggtaccggatgccgttttacagggctcacctgccatccagtagacgccctaccccacgactgcaaccataattacgttgcccggaaccgtcatgctgcttcgtctcatatttcacgagataactggctctgttccgggctttctgcatcgcttccacatcaccacgcttgacccagagcacagcggatccaccagactttttgtctgaagccttcctggtttcagaacatccacccgacaaaggcgtatcatcggaagaagggcgagcatcagatgatgtcggtttacggaaaggcgtccgcctggaaaaatgaaccagtccattaccctgccagggctcgagatgcagagcactgcaccatgccagttggatcagcgtcgccagcgaagaaggaacggtgaaatcccctggcgagcaccaggtatctttgttgagcagtaatatcacgtgataatgtttcctgcctttttccttgccaaactcccgacaccagaaataacgcagagtggttgcacgcacacgcttgttggcacgtcgtttatgtcgctggtaagcctgaatttttgctttcagggatgcaaaaaaacgagaaatcaccgctgaatctaaatcggtatccatgatggtggcaggcatatactcagggaaacgtaaatccacccggattaacgagacggcacggtgttgcgccagggcactgttgagaatactttcaaaacgggataaccagtaagcattgtgtattggttgattcatgatgagagatctccgttgatttggattgacttcacatcattaatcactgcggtaaaactttacggcatcccgccattgagcaacgccaatggctcctgattaaaacagaatgaatcccccacgaagaaaaaataaacctacacgcagagtaaaacacacaacaacggcataaatgttttttaaaaactacaaagcctgaagggaaacggatcaacagaacgcgcaaacaaaacgtcagaaacgcaatcagaacgctttctggcgctgtaaattaacagcaacaccacacctacagcttaaccacacaactcaatcacagagccgaacagcgcgattaaaacctgtttacagacacccccgccccaagaacaaaaaccaccaacatcagaatcgattttcttatactgaaaacgttacttttaactacgctccataaaaacggttaaccatcgataacgtaaacctcatctgaatcaaaacaccagaaccaatcatcacgcttttcctgaaaagagtcttgcgctgagaaaaaacaccagggccagttaatcatctcatcaatctcatcgttacaaaatcatccataaaaccatttaacaaaatcatcgtaagcacacagtaaatcacgccaggttatctcagccggatttgcgtttttacataaagacacttgtctcaggttaacgactaaaaacacaaaaactaagaaaaggttaaacgtaacttcagaaaaatagaatatcatcctgattacttaaacaagaaaaattgttttgtagcagctttaaactgattttagctaacgtaaagatttactaaactggatgtgtatcagatcaaacaatgtgtacagcaatgcttaatgaaaacacttgtagaattgtttatgaaaatgcgtgtataacacttagtgaagatatgtctgtataatacgtatatagtaccattcccgacattctcaatatcttcagacatccatgcagactgagtgttgatttcagtttttcacggccagcatggatctttactggtcaaaaaacagacatgattactctggaattatttttctgattccgtcttcagaacaacaaaaactcgtgataactctacaacaaactatcgtaattggcttctgtaaccccgtcacttttcctaagaaacgtgcccccatatgatgcgggagagataagtcatcgtatacaggaaacactgccaatcataatatggcgtcattcagtaatttttatccataatcagattagcatatcatgattattgaatattatgatatatagctcatatgaatgtgttattatctgtaagcgttaagcatcacattgcataaccatactaagctggataatcatcaacgtttttatatgtaactcattgaaattaattatatgttttttgtggataattaatatgtaatgtgaaattaatattttcacatcatgagcgccatttaaaattaccatcctgaatatcatatgacaatatattttcactaaagcatgaattgtatatatctattaactctggaaaattatcaggattcaccttcaaattcacttgaatgttacgtttaatttcacccagcagttcttcatgtgtggattttattatccctttctcataatcgataaatacacacatgttctttatgaattcaaaaccttttcctgtatacagtttaatgaatgccaccagagcaaacatttcaagatatagccataatgccacgttagttttttgcaaagtataaaaaattgaattcgccactcttttacttattgctcttttatactgtgatcgggcaagattcagtagcggaagctctcgttcaataaatgaatgtgaaaagactggataaattgatgtcggaaacctttcaggtcttatgatattttctatttccaccataaatctatccatagaaagaaagtcactttctttttttattctggtatagagaccgcctttattcctttctgaggtttgttttcgtgctatcccccctaacaatttctctaattgtttatttatcttcgtataattaaatacaaccattcttcttatcatcctcggaaggataataatatcagtgcttgaatcacttgaacggcaattattatttatccatgcaacttcaagttgcagtatcggaacattaacttttctggggtgaatatcactctgatatcgttttttgtatgcgttttcattaagatattctctgctgtagagaaacttatagcaatataatctgataatatcttttatgtaaaatttaaatagttcacctgtaacagatatatgttttctgctcagtaactcctgtgtattaagccattcccgtgaccgaagcacacccttgtgaaaactttttcttacttgctttgaggcacggcattgatgtaatatttttgcgtcctcaataattctctttcccgttttattttttgcagcatctcttactccataaaatatctcccggtccagacttttgtcatatttactgattatacgacaaatattcctgacccgacgattctctttatttcgcttccatagcttataatgatcatcgcataaccttaaggcatttgcctcatcaaattctgaaacaggattactgcattttttattccgacaaatacctttgtttttagccatactcttcttcccgtcaatggaaaaattttcacacccatattacctgaatgataaaccggattagtgtgatccggttcagtgaaatcaacaggataccggtatgccattcagcaattcttccctctccgcgcaagtgaaatcatatctgacgtttcttcctgaagaaatacgccagaaaatccttgaacatctccacggtgttattcattacgagcccgtgattggcattatgggtaaatccggcaccggcaagagcagcctgtgtaatgccatttttcagtcccgtatctgcgccacgcatcccctgaacggctgcacccgccaggctcatcgtcttaccctgcagctcggtgaacgcagaatgacgctggtcgatctgcccggcattggtgaaacaccgcagcatgatcaggaataccgagcgctttatcgtcagttactgccggaactggatctgattatctggatcctgcggagtgatgaacgtgcgtatgctgccgatattgccatgcatcagtttttactgaatgagggcgcagatccctcgcgctttctgtttgttctcagccatgccgatcgcatgtttcctgctgaagaatggaatgccacagaaaaatgcccgtcccgtcaccaggaactctcactggcgacagtaatagcccgggtggccaccctgttcccttcatcatttccggtactccctgtagccgcacctgcaggctggaaccttccagcgctggtgtcactgatgatccacgcgctgccaccacaggcaaccagcgcagtttattcacatatcaggggggaaaaccgctctgaacaggcccggaaacacgcacaacagacttttggtgatgccatcgggaaaagttttgacgacgccgttgcccggttcagttttccggcctggatgttacagcttctgcgtaaagcccgggaccgcattatccacctgctgatcacactgtgggagcgtctgttctgacacactcacgccgacaggatgtgtcgctggattaacgagcattcttctttttatgaaatcatgcttaaaaatcagataattaaaagaatattttttctgctgcattttattcctgattatccggatgcgacacatcctttcaacatcatgatgcataataacatcatgaaataaaagatgttttcttacggagtgcacatctatgtctgataatcgttcccggcatgatcgcctggcggttcgcttatcactcattatcagccgactgatggccggagaatctctgtcactaaaaacactgtcagatgaatttggcgttacagaacgtactttacagcgcgattttcatcagcgtctggttcacctggatttagagtacagaaatggcaggtacagcctcagacgacagagcagcccaggtgcgatccctgaaatgctttcttttatacagaataccgggatcgcacggatacttccgctccggaacggacgactgataacctgtcttaccgacaaccaggagccctctccctgccttatctggctaccggcgccggatatcactgcaacgttccccgagtgtttctcgcaactcatcctggcaataagacagtgtatccacatctctctgatgactgagcgatggtatccgtcactggagccctgccggctcatttattacagcggtagctggtatctgatcgcgttacagaagggaaaactgcaggtctttcctctggcagatatcaaatcagtcagcctgacatcagaacggtttgaacggagaggccacatccacagtctggtcgctgaagagcgttttatctccgccctgccacatttctctttcatccataaacttatcaacacctttaacctgtgatcgccggcctgccaaagccgtcccgacaggtatggagacaatatgttgaacagaaaactaaatatacggctacgtcattccctgaacagtcactgcataccttccatcattatcaataacaccgtacgttcatttcagaggtcagtcatgaataccagagctctttttcccctgctgttcactgtggcatcattctccgcctccgccggcaactgggctgtcaaaaacggctggtgtcagaccatgacggaagatggtcaggcgctggtaatgctgaaaaatggcacgattggtattaccggcctgatgcagggatgcccgaatggtgtacagacgctcctgggcagccgtatcagtattaacggtaacctgatccccacatcacaaatgtgtaatcagcagacgggattcagggctgttgaggtggaaatcggacaggcgccggaaatggtcaaaaaagccgttcactccatagcagagcgtgatgtgtccgttttacaggcatttggtgtacgaatggaattcacccgcggtgatatgctgaaggtctgtccgaaatttgtcacatcacttgccggtttttccccaaaacagacgaccactattaataaagattccgtcctgcaggctgcccggcaggcatacgcccgggaatatgacgaggaaacaacagaaaccgctgattttggctcttacgaagtaaaaggcaataaggttgagtttgaagtattcaatcctgaagaccgtgcgtacgacaaagtgaccgtcacggttggtgctgacggtaatgccaccggcgccagcgttgaatttatcggaaaatagccggtatgtcggactgccaccctgttttattgcccgaaggccctttctcacgcgaacaggcgatggctgtcacaacagcttaccgcaatgtgcttattgaagatgaccagggaacgcatttccggctggttatccgcaatgccgaagggcagctacgctggcggtgctggaattttgaacctgatgccggaaaacagctaaattcgtatctcgccagtgagggaattctcaggcaataaacgtcttcatttcatccatcaggccgcgtcttctccgggagacgcggccttttcgtttataccgctaactcattcataaggagcaaataatgcgattagccagtcgttttggtcatgtaaaccagatacgccgtgaccgtccgctgacacatgaagaactgatgcactatgtacccagtatttttggggaagatcggcatacctcccgcagtgaacgctatgcgtacattcccaccatcaccgtactggaaagcctgcagcgggaaggttttcagccattcttcgcctgccagacccgcgtgcgcgacccgggccgccggggatacaccaaacacatgctgcgtctgcgccgtgacggggagataaacggacaacatgtccctgaaattattctgctcaactctcatgacggtacctccagctaccagatgttacccggatattttcgtgccatctgcaccaatggcctggtctgcggtcagtcgctgggagaagtgcgtgttccgcaccggggaaatgtggtggacagagtcattgaaggggcttacgaggtggtgggggtttttgaccggattgaggaaaagcgtgatgccatgcagtcgctgattctgccgccaccggcacgccaggcgctggcacaggcggcgctgacttaccgttatggtgacgaacatcagcccgtcaccaccgccgacattctgacaccacgacgccgggaggattacggtaaggacctgtggagtgcttatcagaccattcaggagaatatgctgaaaggcggaatttccggtcgcagtgccagagggaaacgtatccatacccgtgccattcacagcatcgacaccgacattaagctcaatcgcgcattgtgggtgatggctgaaacgctgctggagagcatgtgctgatgccttttccctgaaagcgcagttctgactcacgtctgtcccttcccccggggtttcttccattcatttactttttataaggaataatctcatgacaaccgtctcgcataattccaccactccttctgtttccgtaaccgctgcatcagggaatgaccagcctcagttggttgccaccatagtccctgatgaacagcgcatcagcttctggccgcagcattttggcctcattccacagtgggtgaccctggagccccgtgtcttcggctggatggaccgtctgtgtgaagactactgcggtggtatctggaatctgtacaccctgaacaacggtggcgcatttatggcacccgaaccggatgacgatgatgacgaaacatgggtgctgtttaacgtcatgaacggtaaccgcgctgaaatgagcccggaagccgccggcattgccgcctgtctgatgacgtacagtcatcatgcctgtcgtacggagtgttatgccatgacggtccattattaccggctgcgggattacgccctgcagcatccggaatgcagcgccattatgcgcatcatcgactgaatggaggcagggacaatgcagcagctttcctttctgcccggagaaatgacaaccagagagcgcagtctcattctgcgggccctgaaaaccctggaccgccatcttcatgaacccggcgtggccttcacctccacccgtgcggcacgggaatggctgattctgaacatggcgggactggagcgtgaagagttccgggtgctgtatctgaacaaccagaatcagctgattgccggtgaaaccctcttcaccggcaccatcaaccgcacggaagtccatccccgtgaagtgattaaacgcgccctgtatcacaatgccgctgctgtggtgctggcacacaatcacccgtccggtgaagtcacacccagcaaggcagaccgccttatcacggaacgtctggtacaggcactgggcctggtggatatccgggtgccggaccatctgatagtcggtggcagccaggttttctcctttgccgaacatggtctgctttaacccgtcacaaccacatcacgcttgttttcacttttatcttctgtcttcagaggtatcacactatgaaaatcatcacccgtggtgaagccatgcgtattcaccaacaacatccggcatcccgtctttttcctttctgtaccggcaaataccgctggcacggcagcactgaagcgtataccggtcgtgaagtgcaggatattcccggtgtgctggccgtgtttgctgaacgccataaggacagttttggcccgtatgtccggctgatgagcgtcaccctgaactgatgttccgtcacccggaaaacgagtacgaccagatggactcagacgccgctgtggatgaggccattctcgtcaatgcatacatcttcaccgaaaccggtcagcgcgccggctgacctgtcatcgttaaaccattcttaaccacttttcagagaggattttatcgtgtcagacaaactctccgggataactcatcccgacgacaatcacgaccgcccctggtgggggcttccctgcacagtgaggccctgttttggtgcccgtctggtgcaggagggtaaccgcctgcattaccttgccgaccgcgccggtatcagaggccgcttcagcgacgcagatgcataccatctggaccaggcctttccgctgctgatgaaacaactggagctcatgctcaccagcggtgaactgaatccccgccatcagcataccgtcacgctgtatgcgaaaggtctgacctgcaaagctgacactctcggtagcggtggttacgtttatctggctgtttatccgacgcccgaaacgaaaaagtaaaccaccggaataaccttctgctccggcctggtgctttcaccacgccacttttccatttttcatctctgcatatcaggaaaaccttcagtatgaaaacattacccgatacacacgtacgggaggcatcgagctgcccgtctcccgtcaccatctggcagactctgctctcccgactactgggccagcattacggccttacactgaatgacacaccgttcgccgatgaacgtgtgattgagcagcatattgaagctggcatttcactgtgtgatgcggtgaattttctcgtggaaaaatacgcgctggtgcgtaccgaccagccgggattcagcacttgtccccgctctcagttaataaacagtattgatatcctccgggctcgccgggcgaccggcctgatgacccgcgacaattacagaacggtaaataacattaccctgggtaagcatccggagaaacgatgaaacgttccctgatgctggaagccgacagaattaatgtgcaggcactgaacatggggcgaattgtcgttgacgtcgatggtgttaatctcactgaactgattaacaaggtcgctgaaaacggttattcactccgcgtggtggaggaatccgaccaacagtcaacctgcacactaccaccgtttgcaacccttgccggcatacgctgcagtaccgcacatatcacggaaaaggataacgcctggctgtactcgctgtcacaccagaccagtgacttcggtgaatcagaatggattcatttcacaggtagcggatatctgttacgtaccgatgcgtggtcatatccggttctgcggcttaaacgcctggggctgtcaaaaacgttccgtcgtctggttatcacacttacccgacgttatggcgtcagtctcattcatctggatgccagcgctgaatgcctgccgggtttacccactttcaactggtaaccaggaacaacatgaaatcattaaccacggaaaccgcactggatattctgattgcgtggctgcaggacaatatcgactgcgaatcgggaattatctttgacaacaatgaggataaaacggattcagcagcactgttgccctgtatcgaacaggccagagaggatatccgtaccctgcgccaactgcagcttcagcaccagaaccggtgagtctcactcatcatctcactcaccagacttcattccactgacgccagcctgaacacggctggcgttttcatttatctgcaaaaaggaatatcgattatgtctgaaatcacagtctcccgtccggaagtggtcaacgagaatacggacgttatctgctccacctcagtcaggtacaggtcactggaatatgataattttccggaaatcagcgaagcgaacattctgagcacatttgaacaactgcaccagaacaaagatgaagtgtttgaacggggagtgatcaacgtcttcaaagggctgagctgggattacaaaaccaactcaccctgtaaatttggcagtaaaattatcgtcaacaatctggtgagatgggaccagtggggatttcatcttatcagtggaatgcaggcagatcgcctggctgacctggaaagaatgttgcatctgctcagcggtaaaccgatccccgacaaccgagggaatatcaccattaatctggatgaccacatacagtccgttcagggtaaaggacgctatgaagatgagatgttcatcattaaatactttaagaagggatctgcacacatcactttcaaaaggctggagctgattgacagaattaacgatataatagccaggcactttccttctgtgctctcagcctgaccccgagtttgattccctttcgatatcaaaagggactgcgggtacaaaagagggtacatctttcaccaaaccaaacaaaataaactaatatcaacatgatagaagcattcttcgattccgagtccggcaccaccttacatcaaagccactggtcaggagtgagaaccctgacgagtgtcatcgggaaggtgtaagatgtcgtgaatgtctctcatgccatctcattttctcgatttaaggagcatgttggtcgcatgctccttttctcgagcatttattatgcttgcaaagctttttcaggttgtcaacaacggcaaaacaaagtcatgatctaaaatacatcagtaagttctgccagttctttttcaagcactcttgccgtccccttcaaatcgatttccacatactccagagtggtggaaacattcctgtgcccgagcatggttttcaccatataaagattacgttccggtgcactcatcagcgtactggccagcgtatgccgaaagcgatgaggtgatacagggaaaccgcactctttcgtcagacgtctgaaaaatccttttaccggttgcagttccggaagtccggtaacgaacggtgcttctgacatcaatgacacataacgatgataatggaaaagataatcctcaggtcttgccccccgtttcatcgcttcatcaatcaagtgcctcattcccgggacaagatgactgaccatagggatacgccactcatggtgtgtcttacttccctccgaacacagatcaatccatctttcatccggattaacatcccgcagacgcaggtgaagtaactgatttagcctcatcccggtaaaacgcagcgtatttaccacaatcatccagtaccatgccggacgaatcgcacaactacgccagtgcacaccaccagaacgcttctcctcttcatgaaactgttcaagaatcagcagaattcgttttacctatttcttcgtcagtgttttcttacgtttcttttcctgtctgacataccatcaaacggattctcacttaaattaagaagtgttgaagaacatgcaaaattgaaaatggcacgcatatggcgaaccttgttattccatgtgtgcgtggagcgattttgttttttcagaacctctcgtttccattccctcacatgctgttgccggatatcctccggtaaaagggtctcgccaacaaacttccggaatccattcagaacctttaggtaactccactccgtagccactctcactgaacggcagaaaaaatattcatccataagctcgttccagcgcatgtcagcatgacttaatttcataattaaaccctttacaaataggttacatttttaccaaaatacttacctcctgcgctcactgaaaaaaaagttcggactgtcattgagatcccctgtatccatcagaccacgtccttttatcagataacctttgagtattttataatcgtgtgttttccctggtgcctcagcaattcgcgcatgataaaaacgctgattatcttttcgcttatggatattcagtcgttcaaatgcagcctgtagctcctctctcttctccccggggagttgccgggctttcaggtaatcataaaaaacccccggcacaggaatgaagacaaagccggcaaccacatgaattttatcgcctttattgttaaacgacagtgaactattcttcaatccgtctttcagccattcaagaaaccgctctcctgttaaatcaggattaacagcatcagattctgcttcacagtattcctgttgctcagcgtcttgatacgactgacagatttccccatggcccgctgctgatatctctcctgtcgatgaaacaggcgcaaccacctcgccagatggcgagtcatcctcccccttttccggcgccctcgcctcctccgcaaacatgcttaccagcatagctgtatcttcatctgtcggtatactctccgtttcacatcctgcatcgccctctgaaccttcactgctgtctggtgtcgtcgggttctcagcctgttgttgccgcatctctggttgttcctgaacagactctgcagcattgccggacacggtattcccttcagccgcagcctcttccccggacacagccgatgccacggtgctctccgttttaccggatacaaccacctcccccgtaaagacctctgctgaagcaatatgactggctgtggcaacaattccaccgtttaacaacggactttcagcctggcgggccgcctcctgcagaacatcacggatgagtgccatttccggatgctgatgccagaacgcaccggccagattctgaagcgctcccggcaccgtcgcaagccaggctgcagccccctcaggtaacagaccaccggcaatcactgccgccagttgctgagcttccgtaccctgtggcgggagctgcctgaaccggaaacgatacgcctcatcaggaacggatattcccggctgccatccccggccgctgaacaatttgccttccagatgcgcaagcagaggcaggtgataaaacagggctgaccagaaaatcactgcatgccaggccgccccctgtgcggcctgctcttccgcagaggcgcccggcggaaacatatgtgcacgggccagacggacagcgtaactggtatgcaacaacgtcaggtccccgaatccccctgcatgtgaccagcgcccctcccgggccgccgggacattctgcgtggagagaagcaggctgtatacgggagcacaacacatcgcctcacacaatggctttggcatcatattgttatcccgtatctgcttcagacactgcgccctgttcttcggcatcagcagtgaatctgtcgtcagcggcgcataaaagccttccggtgttcccggcactgaccgcccgtcatcgggtatctccactgctgaaccggaggtaaaaaacttccgtaacttaaacatcctttccctccaccgccttctctgtgccacgctgatgcggggacgtcgtcttctccttcgtcctgctcttttcctccgccagttgctgcatgagttcattgagtaccagcgtcctgcgtgcccgggtcaccgccacatacaacaggttagtttcatcccggcgctcctgttctgacatcaacggatcagcgatatcctgaaaatcatcccccagtacaacccgctcccattccagccccttactgcggtgcgccgttgaaaccgtgatatcagcctcccgctcgttcgtgactgtgtgctccctgagtagctccagttttttgggtaacggaaaacacagctccagtagtcgtatggactgactcatttccacatccttcgtcaccttcgcaatatgacggtattcatcaaaattccggtaatccctgcgcaaccggtcagagtgcatccgggccggcatatccatctggaaccagtaaagatcttcaagcgcctccgttcggtatccctcaatgcccccgacccagtaaaccttcctgcccgccattgccgccatcagcgccgtgccaatcactccggcgacggtccggttcagtaccgcccggtgtcccccaaattttccacgcttcatgcgctcacgcatttcctgcatggtaagcacctcatcatcaccaccgcagccgctcacctcccgactttcccctgcgcgtttcagcagcagattagccatcgcggccactgcggggccaaaacgaaaactctgtgtcagccagagacggtcggcaccggccagagacggatgagacagggcatcatccgcgccacgaaaacggtagatctgctgataccggtcaccgaccagcacaatcctgcaccgctgtcccagcacaagtgcggaagtcaccggattcgcatcctgcgcttcatcaaacagaatggtgtcccatctgcgcgagagatcaggtccggagagctgaaacaatttgagataggtgtcatgggtgaccggaaacgttccatccggatcgctcatggcctgccagagcgtcctcacagcacgaagtgcctcatccggagcaacgcctttcatttcgtccttgtccggcagatgctgcctgccgggggttgcatccgctgagcagataaactgattcagccctgtcatggccacccgggccagtgcccagtatcgggtattcagttttcttgccacatcggtgacgaacaagcccggaacaagccgcttctggtaatgccttccgaagcgggcaaacgccagctgatgcgacgttttgcattcaacgttaaaaggaaacctgcgctcagcttcatcacgaatcgcacgattataggcgagatagagcatcctgctttccgggcaggccatggcatagctgaccagtgtgctggttttccctgtaccggcaaaagcattaacaacaagcttcctcccctgccagtgaataattgccgtctgttcttctgtcggtttatggggcatggctttcctccgtaaagacgaaatttccggtcactctgccttcagccaggcgaccgtgaccagcattaatttaccctggtgaccagaaaattttaccgcccgtaaatttttagcgacctgaaaagaattaattatcgccacccgggtatccgctgttcattatcccctcagacacagcccacaacgggcctgctgtatcaccgttcttcgtaacggtcatgctctttaacaatccgggagcggccacgccctgaagccgggctgaggaggaaaacagatatgctacgtagagagtgacgtgccgcgcctgcagccacaggtaacactcccccaacaccgggcaccgcaaataatggctacacaacccgaaaacgcactgagcgccagaacagtacgtttccggttgtgccggagcctgcaccctgcagagtcctgaacaacagccagtaaaaccaggcactttcggcgacatcattttccccatggtgatgtcgccttttttcagcacagaatgataatgcacagcaggagtacagataatgccatcagcacaggccaccccggtcccgtataaatactgtattcaggccaccatcgaaaaacccggcggtacaccggtttcatggattcgcttccagaatacgcccatgacgaaacaggagtgtgaaaaactcttctccactgaaaaagaagccggtaaatcattcaccgttaaagtcggggttactcaattttcatgtaaggaaaatccacctgcacctggagagtgatttttattatgcctcatcccatcacatatacaaattttcttccggtggttctgtttttcgttatcgttatttttattatcacttttataatagccatcaccacgaccatccccgcagatatgactgtaagaggcttttacaatagatacagaaaggattttctgtctcttttttcggcatatttcctttcatcaatattctgagcattcctggtgacaggcaccagtatttcagacagcacgccggttttcggtagtacaccggacaatgcgattacaaactcgctgatttcactggcgttctgtaattcgttattaactcacgcatggatttgtgatctctgcgacatacacagaaacaaaaacacctttatttatataaccctggcttttcttcatcttattttaatcaattcatgcacccattttatctacgccactttttattaattcagttaactccgtcttaacagacagaaatagtgaaaaaggtgatactgatgaatatattaaaatacttaagtatttcgctcttcgcgttctcattttcatataccgccacagcctccactcagatatcatcatcgcacaaccacgccgaaaaacgtgcaatcggtacgctgaaatttatacgggccgacggacaacgaccgtttggtcaggctatgaaacaattattacccacaggctggcgtactgagattgcccgtgacgtccggctccccgccagaatatcatggtccggaaatgaccagtggaaccatgttatcgaaaaaacgctgccccgctacagcctgaaagccacatttgatacctcagggaaacgcgtactgatccagcaggcggaaaaaacggtaaaatctggcctgttttctgcccccgtaaccggtgtcaaaaaaacagaaacacgtcatattgagcagggaatgcccctgcgtacagggctggaaaaatgggcagccgccgaaccctgcgctaccgggaaatggaaagtggcatggaaaacgccggtaaattacagtatcgatgcccggttagttttttcaggtaattttatggatgcactgaacagtacattcgcactttatcagcaggctgaaaaacccttatatgcctcggtgaataaaaaccagtgcgtgctgataattactgacatcccgggggacagctaaatgggatggctcatgcccctcataatggcactgtttatcatcgggaactggtttcatgccggcaatacggagcgggcaataaaaaatactgatgagcagcaaagacaacaacaggtatatgaaatattacgcctgacaaatgccattaatgactggaaatatcatcatcccggtgatatccgtgaaggaaagatgcttacggttaacgaaaccggattcgctccggtatacggaacaaaacatattatttcagggcaaagaacttttgtctggcttccttttcagccagggctgatatcagccctgaatgaagtgagccgaaactcagcattaattgcgcaggtcagggacagaaagttactggataaccagggaaataatattggtgttccgccttccgttataccggaaaatgcgatcgtcctgatcaattaagcatccccaaaaggggattctgcactgaggtctgcatatcatgtcttctctcagcaacatgatatatcgctacggcgcagacttcagtccggaaaatctttctcagtgttcattaacacatgaaatacccgtcgctctgtctcactgaattgttatttcgtccctccacagacagagaataaatattcaacaagcaggtatacagaatatgaaaaaatttttctgcgctgtcaccgccttatccgttgttttatcaggctgcagcagttttgaacgaatcagtgccacagaaaaaaaagcatccgatgagataacacgggctgaacgtatagccggtgaacttcgcaaacaacgcgccgttgtgcgcgaaacaaaccagcagtggatcaataccacgccccttccggaaaaaaccgttacccgggcaataccggattgcccggtcgtcataaacacccgggaagccatcacacttcaccagattgcacagcggatttctgaaacctgtcatattccggttcaaatcatgtctgatgtctggacactgctgggtaccggagaaaatcgcacacagaggatcagcggcgacattcccccgcctgataccagtggcatgcagccactgagcaccgtggggctgtcatcagccgccccctccacggcctcactgccggaactcaatgttcaggggctgcccgctttgcttgacaccgtatcttcacgctttgggatcacctggcgctatgtgaagggaaaaattgaattccactggcttgacacccgtacattcccggtcacctacatggacagccaggtcgcctacaatgccagagtcgtcagtggcaccatgtcatccacgggcagttccggtggttcatccggcagttccctgagtggggatgccagcaatacgcagacaaccgccgttgatatgaaatccacactctatgaagacacaaaaaatgccgtgaattccatgctgacgcccggtatcggaaggatggtgttgtccaccggctttctgaccgtaaccgacaccccacaggttctggatactgttaagaattttatggaagaacgtaaccgggaaatgcgccgtcaggttgtgctgaatattgaaattctgagcatcaaaaaaaccagcaaagagcaggccggaatcgactggaacgccgttttcagtgacggacatctcggtatcgacctgaccagtgcatttactaatgccgccgatgaagtcgtgaccagtggggtatcgattattgacggtaagctcaccggttcaaaagcctttctgaaagcgctttcatcacagggtaaagtcagtgtggtcacccaaaactcggctgtcaccaaaaacctgacgccggttcctatgcaggtcgccagccagcaggggtacatagaaagtgtcaccacggatacgacggccaatgtgggctcctccacctcactgaatgcggcaacaatcaccaccggcttcaacatgacactgttaccgtttatccagcccggctcacaccggttgcagttactgttcagcatgagcctgtccgacaaacctgtttttgaagtgtttgaaagcggtggcagtcgggcccagacaccgagtgttgagctgaaaaccatcaaccagaccatcgacctgaaatcagatcagacggtgatcctgagcggattccagcagttcagccggaaatcgctcagacagggcgtgggcaccccgtcattcttcggactcggtggtggcgtggacagtgcggatgacgacaccattctggttgtgctgatcacaccgcacgtaatctgacggaggttcccttgaacgggtcaatgcagaaaaaaattcgtccggtttcactgatatcgggtaaacaggcattccttgcgggccttgactggaagaacatacctcccggttaccggaatgcccggcggtttgcccggtcacagggcgcagaactgtatctttcctgccacaaccacgacggtgaaaacggtgatgaaatgatgattgccctgctcagtcgtcaggatgcagatatcccccgtaacattcgccagtgcctgtcactggcaatgttaatacgcccgctactcaaatcaggtgggtatgccattttcatcatcgggaacgacgagaacgacgacgctgaactcacctgtgcgtttgtttcggtgattaatggcattctggttaacgacgttaccggtaccccgactgaaatcacggaagcccgcaacacgttcctgatgctcaatgcggaaccggaaaacggctgggtacgctacgaacctgacggtttttcaccagacagtcggtgtatcccgctaccgctgtcaaacctgatcagcaccagaaagcatccggcagaagcgcgtctgctccccgtgtccagaggcccacagttaatgacagccttactcatcatcacgctgcttggcgcatcgtggtacggctggcaacgttatgaaatctggcaggcggaaaaagcggaacgggaagaaagcgcccggaaatcagctgaagcacgtataacgccaccatggacggggcagcctgagaccggagaatttatccggcaatgcagcacaacatggaaccagacgcaactgtctgctgccggatggcgttataccctggctgaatgttcttctgacggtaacagcggtaatctgcggtcttcatacaccaatacagcaggaacgacagtgacagccttcatccggcgcatcactgaactcacagacacccggccgtttattgttatgcctgaagggaactctggcggcgttgcactgccggtcacattccggctcccggataatcctgtcccggttgattcccttccggaaacccgagacctgcaggaacgactgaccacgctcgcacagtcagttcaactgcagattgactggcaggaagtcaataacagcttcactgatgaaaacggaaacatcatccagccaccgtggaaagagtatgacctgcagatacagacgctactcccggctaaccaactggcagagcgcttcagcgagccatctgtccgttttctctccgtcactagacaactggaaaatggtcgtttccgttatcagttcacaggtaaatattatgcacgataaaacaaaagcgctgctgattgcagccctgctgttaccggcaatggcagtggccggcaacgaaaatgacgcgtcacagaacaaacaactgcagattgagcagattcaggaagaaaccgccctgtatgaagcgatgctggcaagagaaaaaattcgtcatgaattgcggacactggaacagggtatctccccggtttccggttctgtcacgggacatcagccggaaaatgcggctggcaccccctccggttcacaggcattatcatccccccgtctgaaagaaatctttggtattcagccacagctttcagcacgcgtcatactccccggaggaactgaaactgatgtcagggccggacaggcattacccggtacactgttcatggtggaacaaatcacaccggacagtgtgattctggaatacaacggcaacaggcagacgctacgcccgtgaggtgccatcatgccagagactatcgtactgcctcctgaagatattcgtgatttcgtcgcaattcagcatgacgctgacggaaaaatcagggtgaaagtcgtcgaggcgaagaagcacatcacctctgtacaacgttacctgacgctcttacgctcccgctatccgggaaaaatcagcaaattcgattttaccactcttgacgttatcgcaaccctgaacagcaataatacggaacgtgcaccaggcgttttatccgacggagggatcaacacagtacaaagaaaagttcttgattacatcagaaaagccgctcaactggatgcctcagatctgcatatcacaccaggacgcgacaacacggacttcacctatgtggaagcccgggttcacggcgaactggaagtgctcgatatcctccggaaagaagaaggtctcgaattactgggggccacctattccggcatgaccgacgtcatcaagggcacacagtttgatcccggggtgcctcaggatgcgcgtctttcagagcagtacctgaaactggccggtctgtttggtgcacgctactcccactatccctgcgtgggcggcctctatgctgtgctccgtctgatcaaggatgacagtctgcaaatcccgaccttcagcatgctgggctatcaccctgaccaggagctcaccctgcgccgtattctgcagcgccctgaaggtattatcacgctctcaggaccaacaggttcaggaaaatccaccacgctgagaaccgcctctgcggcataccttgaacagtacggcttcaacaataccggcggtattcttctgccccgtcgcaggctgttcaccattgaatccccgccagagggccgtatacccggtgccattcagactgccgtcatggattccgcacagggctgggtggactccattaaatcagcactgcgtcttgaccctgacgggatcctgaacggcgaaatccgtgaccacgattccgccattacggcaataaaagccgccatgaccgggcatctgatgctgaccaccatccatgcgaacgacccgattaacattctcgaacgtcttgagatggagggggtacaggcaaggatgattgccgatccgcagctgttcattggcctgctgagccagcgtctggttcagctgatatgtccgcactgccgtcgcccctggcatgaggtggccaccgaccgcacggatgatgaacggcgcctggtggaaagcgtctgtaacccggaccaggtatatctgagaaaccatgaaggctgcccgcactgctggcgtggcgtgacggggcgaacggtgatcgcagaagttatctccccggatgcgcgttttttccagctgtaccgggaaaaggggcgtatcgaggccagaacctactggcaccgggaactgggcggaatgacccgtaatcagcatctgctgggaaaaatcaacagcggacaggttgatccgctggcggcccattacatctctcccgtcgatgaggacagctatacgctgctgcactgatatgaaatatctggaaaaactccacagtaccgacatcgagctgacagcactgaccgtctggatagccagaaaaacctttgccctgaaccgggtggagttctacgaagccctgggcggcatgatacgtgacggaacgccgtccctgcgtgccctcgaatttctctgcgagatcgaaaccgattttggtgaaaagaaaggcacatccggcatgtattttctggcaaaagaatgcatcgcgtccatcaaagccagcggcatgttatccggtgccctgttcacctgggtgccaccggaggaagccacgttaatcagaaacggggaagagcgcgggaatattgccgacgcccttttccaggtggccagaaccgttaaagcccggcgggaaatgacatccagcctcattgccgtctgcctctatccccttctgctgctttcactctgtgtggtgaacatgtacaacgcccatacccgtatcattcccatcgtcagtgcgtttgccacggaagataaatggtcattccagatgaaagtgctggccggcatgtcggaatttatcatcgggtacggactctggctctgcggggccattatcgccctgacggttctgatccgtttttccttcagcaggtacaccggccccggccggaggatgctggacagggtaccaccctggtcactgtatcagaccttacacggagtgaattatctgttcagtatttcatccatgctgcagattaatattccgctttcgcaggcactgctcagaatggaaaaaggggcagaaaagaataaatggttaaaggagagaattcaggcaatacgaaaacatgtgttatccggtcagaatctggccacggcaatgcgaaattccggttacgattttccgtccagagtatgcatcaataaactgctcctgaattccgaaagggaggataatgtggcagccatggcggtctatgccgaccagtggctggaagaggcaaaaaaacgggtaaaacgcagcggattaattattaccggtatatcaggaggttttgtcttcttttttattcttaacatgatatctgccatctacagtatcagcgacatgctgaaacaataacccccaccatacagaatatttctgaaacatcccataaaccaggagtgatatatgaacttcagagcacgtcttttttattatttttctttaaaaaaagaagaggaggataaaggtttaaccttaatggaaattgccggcgcactgattattatcggtattgtggttggtctcgcaataagtcagatgtccagtaccatgtcatccagtgataaccagcgcgaactgaaaaacctgcagaccattgccaccaaaatgaagcagtacaagttccagggacaatataccagcagtgattatatcaaaacgctgacgcagagtggttccctgccggccgatatgatcgccggtggtaacaaggccaaaaatgcctggggcggtgatgtcaccattaaggcaacaacagataagtatggttatacgattaccagcaataatgtaccgaaagaaaattgcgtggaactcattaacagcctgcgcagttcatccatgtttaccaaaatcatgaataccaccccggctactgtggatcctgtaacagtatgtagtaaggacaaaaataacatcacccttgaaacaaacagctaatgtttccggacagcatccttaaatacaagaggatgctgtcactgccgggattatcataatgaaatggttatatttctctgtcctgattttattcagtcatacatcaatcgcatctgtgatgaataataatcatctcgattcctgttttattcaggccggaaaacgttacctgattgcccctgagcttctgaaaaccattgcacagcaggaaagcggcctggtcgccactgcgataaatcacaataaaaacaaatccggaaaaatcatcagtacggattacggaataatgcagattaattcatcgcatattcctgaactgaaaaaactgggcgtcattaaagacaaggatgaactgcttaaaaatccctgcctgaatattcataccggcgcctggatactggcccgccattttcaacgctgcggcgttaactgggaatgccttggcagttacaacgcaggattcagcaaaaataacacagcccggcgcatgatatatgcccgaataatccacaaccggtatttcagaaaagattaagctgaggtgactgtgtctgaattactcccgatatgcattatcctgattgtccttgcggcaattctgtatcttgcatacagcgccgccacggtatatttgtcgcaggtacacaatacccgcccacacaacgctgcggtgtgcatctgttgtcttctggctgtactgagcatttgcctcaacggtgcatatggtgttgacgcgacaggactgttattcctttccattctgacgggattattaactgtaatgacgctgacggatattgctgtctgtcggcttccccggatattcacgctttctcttattattctgggcgcagcgttcagatacagccaggactcactggctcatgccctgctcaacgcgtcactgtggttcggcatgatatacctgttacgacgcatttttctggcagtgaaagggacggaagcgctcggccttggtgatgtgttcctgattgcggggatcgcaatgtggacacaaccgcaacacactccactgataatcaccgccgcagcctccggagcatttctgtttatcctcattttctgccgtcgcagacgccagcaggcactgccatttgctccgtttctctgcgcgtccctgtatgtgctgaccctcttccctgattccgttatccacacatcggagatattcacgtgaaaaaattcagactcgatgacgataaaggttttattctgcttgaaattcttgctggcctgatagtaattggtatcgccacaccaatgatttattcagaaattgaagactggctgaatgaacaactttatcaaagtgcggctttacatgctgatgaatataataatgcaataaaaaattatgtagctgataaaaccagctcactttccagtaaaaccatcacggtaaatgaattaattcagcagggatatctgaacaacggattttcccgctccccctttggacacagctatattaccggtatcagaaaaaataatttatccggtcgtctggaagcacttacctgcacaaccggaggacaggatattaaagaagatgggttacgtcgcatagcgggccagattaatggactcggtggttttatgctccagaataattccgttacaggtgcctttggcggctggaccgatctgggaagtaattatcagattacctgcaacaagggccatatcgccatgcgaatggctggaaaagatctggaggaaagcgatcggctttaccgctacagcgttccgggaagacccgatttaaacagaatgcatactggcattgatatgaataataacagcatcaccaatatcaatgaagccagtggtaaaaacgccagattttcaggcgatgtcacatcaaatcgttggttacatccaaatggtggcggcttcaccatgacggacagccagtggatacgtgctgttaacaacaaagggatcacaaccgaaggagagatcaaaggtggaactgtccgtggccagacagtcactggaggaacggtccgctctgatggtcgtcttactgccggcgagtatttacagctaaacggaatcgccaacgcaggcactcattgctcaccagacgggcttgtaggccgcgacaacagcggggccatacttcagtgccaatccggtgcctggtcggggtttgaatcctaccccgtgggaagtcctatcccgtggccatctgccactcctccacaaggctatctgttgatgaacggccagtcgttttcctgttcccggtatcctcagcttgcccgtgcttatcctggctgtaaattgcccgatctgcgcggtgtttttatccgtggctgggataacgggaagggacttgatggtgatcggaacagacaactcctgagttatcaggccgatcaatcaggcgtctatcacgaacgtggcggatggctgaaagggcatcatagtggtatgccatactgggcacaggggagtaccacagaaatgcgtcccaaaaatattgcattcaactacattgttaaagccagctagggactcacatctgataggcatacacagagaaaacaccgttaccacaggcgtaattttgtgttggtctggagatgatttgatatgacgctcccactggcacggcaaatgaaataaatgctgtctttccgtaggaggggttattgctggcattcataccaatgaaagcgccgttcacatagacctgaagatttgatgtgttggcgcaatcaccgccaccggcaccatttccaccggaagcgtacacaaacaaagttcctctgccgttattcctcccattaaatgttccccggtgagaacccagattgctgtaacttccgtcaggtgcaccaatcgttcgccacacaccggatttggcacggaggccagtgctaatccggtatctggacaacgacaaaaatgaacttcactaccagtacatacaatatcgggaaaaatactcgtaatctgagcattggcgtacatgcgtactgctcgtggacataccttaatggctcgccttttggtggttttcagcagatatacgccgacaaaaacaaggtttggtatgtgaataattatgcgtggggaaattatgagtccggtggcacaattacagtgacatgcctcaaccttcctggtgccggaatctaaccaaaagggcaacagtaagcatcgacgtgctcttcatcaacaccatctccgatgccgtacattcttgtacctgtcatgacgtacccggcagggcactgaatcggcttgtaataaatagaacctccgcttctgccaccgataaaatgtgcggaggtcgcttcataccatttacaggcagaatagttcactttattgcctccaagccacaaaccggattggcacagagacattgcatttctgattcagtattcctaccttcctgggatttatcgtggaaggcagatatgtttcgaaaaataaaaattcgcaaaatgactctcaaccgggcgctggacaaatacctgaagacagtatccatccacaaaaaaggtcatctgcaggagttttatcgcgtcaatgtgattaaacgtcaccctatggccgagcgctatatggatgaaatcaccaccgttgatatcgccacttaccgggatcagcgtttggctcaaattaacccacgaacagggcgtcaaatcaccggaaacaccgtccgtcttgaacttgctcttttatcatcattattcaatatcgccagtgtggaatgggggacatgccgtatgaatcctgttgaactggtccgaaaacccaaaatcagtagtggacgcgatcgtcgcctgacttctggcgaagaacgccgactctcccgctatttcagagataaaaatcagcagctctacgttatcttccatctggccctagaaacagcaatgcgacagggggaaatcctcacattacgctgggaacacctcgatttgcagcacggagtggcgcatcttcctgaaacgaaaaatggtttaccacgcgatgtcccactctcccggaaagctcgcaactacctgcaaattctgccacaacagataaacggcaatgtgttcagttacacctcatccggtttcaaaagcgcctggcgtaccgcacttctggacctgaaaatagaaaatctgcattttcacgaccttcgccatgaagccatcagccgtttttttgaactcggcacactcaacgtcatggaggttgcggccatttccggccatcgctctctcaacatgctgaagcgatatactcatctgcgggcgtatcagctggtcagcaagctcgatacaaagcgtaaacagacctgcaaaatcgccccctattttgttccctatcccgcaacagtcgggaacagaaacggactgttcattgtgacactgcacgatttcgaccttgaaacccgtgctgaaacccgggaactggcaatatctcatgccagcgtattgttgctgcgcacactggcacaggcggctcagcggggtgaacgcgttccaacgccaggcgagctacccgcaaacattgatgcacgggtcatgatttgtccgttaacaagctgaaggcatatcagaatgaaaataaactataaattccggattaacttaatcacagtccttctgtctcagctcctgatacagatatatttgtggcataatattccggtatccggacatattccactccccattatattacttatatccatattcttatcaggcctggccatctgtactgcattctggctggcatatgacagtgacagatttaagaaactatcactgccaaagcaaattattctgttagtgttatatactgccggattcacttttttaatattatacgacttcatgtaataaacaacagttctggaaacaaccttatgaccttataaacaagggcgcctgcaatactccccacgcaatacaaataaccacttctgccgcagaatgcagaccaacaacatatctggccacacccagccctgggcccctacaaagagtggttaacactcttttaaaacactcgatcataacgatcgaaataactcatttccgtttaaaaaacactctctttagactcaacttatgaacacaacgcgctgagccgcacggagaacagaatgaaaccaaacagcactggcattgctgcccgcatgatactctccctggacagggcccggatttgtgaagccctgctcaacaaccgccagctgcagcccacgccactgcaggttcgttatccacagggcgtcagggaagccctcagcatcatgagcgaacagctttccctctccgtctctgacctgacgcgtatcctggtcgaagaggcattaagtgagatgtttctccccgcggataacagcgtccgccgtcttcacgaccgtatggaatatctcatgcaggtgcatgagctcagcccggtcaccatggccacattactggccccctggaatatccgccctgccgtcttccgggagccggacagactcactgactacctaaccggggaaatccttgcctcactggctgactggttttatctcagtcctgaatggctgaacggcagggtgcattatccgctgtgtcatccgggagactggcccgaaacacaggacgcgttctgccgtcttatttcagaagacgataatatcgatattattctctggcatggttttcctttttccggtgaacacgctcaggaatattgtggcgttcttctgcgccagaaaaagaaaattaacaatgccattatttacccggtactttctttatatccgacaggaatgaacaaaaagaaagagggctggtttcagatggccagaaaaatgtcaccggatatccccgtcagggccgtcacgctcagtccggcacaggcggaatatctggtcacaggaaaaatattaccggctgagttattccgaattcccttatcgccctggtaataacacgttattaaacactgactgtttttaatggcacaggcgtgccacgcctttgctatacccgaaagaccttaatacaggaaactgaaatgatgatgaaaaagcatattacccgtacacttgtcgcgtctgccgttttattttcctttaattcagcggccgccacctcatattctgaagcccgtaatgatgcaatgggcggaaccggcgtcgcctcctctcactatggcgtggcaccgctggcaaacccggcgctgctgacaaaagccggtcctgacgatgatttcagccttctgcttccgtccgtcggtgcgcaactctccgacccggataatatcaccgacaacgccgaccggatcagtgatgactggaaggccttcgaccgcgccatcgacagtaaccacggtgttcctgaggctgccgcacgcctgaaagaacgcctccgggacttccgtcacacacatgccgccgcacagttgggcgtttctgctgtggcggcccttcccggtgaccgcctctctgccgcactgatggttaaatcacacggcaccgtcagtgtcgacggtaaagtctctgatgctgacctcacttacctggaagaggtggcaaacagcaccggacaggaggtggacaaaagccgcctgacatcacaggcctttgcccgcgcggcactgatcactgatgtgggtattgctctggctacggaactggaaacggccgggcagaaatggtctctgggcttcacccccaaattccagcgcgtcgacctgttcaactacaacgtgctggtcagaaattatgacagcagcgccttcaaaggcgaccgctaccacaacacgaaaaatggcatcaacgccgacatcggtgccagtacggacctggatgacaactggacgctggggctggtcgcacagaacctgatcccccgtagtattgagacaaaagaagtgaacggtatcacggaaaccttcaggatccgcccgcaggtgacggccggtgtctcctggcacaacgcgatgttcaccaccgcatttgatgtggatctgaccccggccagcggtttcacctccgacagcaaccgtcagtttgccgccattggcgcagaatttaatgcctggaaatgggcacagctgcgcgccggttaccgtcagaatctggccggtaacgacggcagtgcattcacggccggggtggggatctcaccgtttgatgtggttcaccttgatgttgcaggcctgatcggcacggacaacacttacggtgcggtcgcacagttccagttcaccttctgagttccacctgcaaaacagcatgcacattatcgctgcatgttgtttccatcatcaaaagtctgtcggacatcgacagacttaactcccccggataatacagaaaacctgtaaaggattgaccggaaacaacaaagatcaaattttgatcacagagttcaaaacacaaacaccaagtgatcaatatctgatcaatcaatcacttgtgtttatctttttttttattttgttacatctgtcatacaaatataactgacagtgattatcattatacccctatcagttacgtgccgtgactgatagttacccgttgtaattaaatgttatcccataaccacaactcagaaatatcggagttcacgtatgaataaaatttattcactgaaatatagtcatattacaggtggattagttgctgtttctgaactgacccggaaagttagtgtcggtacatcaagaaagaaagttatcctcggtattattttatcctcaatatatggaagttatggcgaaacagcatttgcagcaatgctggatataaataatatatggacccgcgattatcttgaccttgctcaaaacagaggagagttcagaccgggtgcaacaaatgttcaattaatgatgaaagatggaaagatatttcattttccagaactacctgtacctgacttttctgctgtttccaacaaaggtgcaacaacatcaattggaggtgcgtacagtgttactgcgactcataacggtacacagcatcatgcaataacaacacagtcatgggatcagacagcatataaagcaagtaacagagtatcatctggcgacttttcggttcatcgtctgaataaattcgtcgtggaaacaacaggggttacggagagtgccgacttctcactttctcccgaagatgcgatgaaaagatatggcgtaaactacaacggtaaggaacaaataattggcttcagagcaggtgccggaacaacttcaacgatattaaacggcaaacaatatctgtttggacaaaactataatcccgacttgttaagcgcaagtctttttaatctggactggaaaaacaagagttacatttataccaacagaaccccttttaaaaactcaccaatttttggcgatagtggttctggttcttatctatatgataaagaacaacaaaaatgggttttccatggtgttaccagtacagttggttttatcagtagtaccaatatagcctggacaaactacgcgttatttaataatgaccgggtaaacaatttaaaaaataatttcacaaacactatgcagctggatggtaaaaaacaagagttatcatcgattataaaagataaggacctgtctgtctcaggaggaggggaattaacgctcaagcaggataccgatcttggcattggcgggcttatattcgataagaaccagacatataaagtgtccggaaaagataagtcttataaaggtgccgggatagatattgataataataccaccgttgaatggaatgttaagggcgttgccggagataatctgcataaaataggtagtggtactctggatgtaaaaacagcacagggaaataaccttaaaacaggtaatgggactgtcatccttagtgctgaaaaagccttcaataaaatttacatggccggaggtaaaggtacggtaaaaataaatgccaaagacgctttaagcgaaagcggtaatggcgaaatctattttaccagaaatggcggaacactggatctaaacggctatgaccagtcatttcagaaaatcgcagcaacagatgcgggaacaaccgtaacgaactcaaacgtgaagcaatcaacattatcacttactaatactgatgcatatatgtaccatgggaatgtatcaggtaatataagcataaatcatattatcaatactacccagaaacataacaataataccaatctgatctttgatggctcagtcgatatcaaaaacgatatctctgtccggaatgcacagttaacattacaaggacatgcgacagaacatgccatatttaaagaaggcagtaacaactgtctaattcctcttttatgtcaaaaagactattctgctgccataagggactaggaaagcactgtaaataaacgttacaatacggaatataagtccaacaatcaggtagcctctttttcccagcccgactgggaaagtcgtaaatttaatttccggaaattaaatttagaaaacgcaaccctgagtataggccgggatgctaatgtaaaaggacacatagaggctaaaaactctcaaattgttctgggaaataaaactgcatacattgacatgttctcaggaagaaacattactggcgaaggttttggattcagacaacaggttcactccggggattcagcaggcgaaagtagtttcaacggcagtctgagtgctcaaaacagcaaaataactgttggtgataaatcaactgttactatgactggtgcattatccttaattaatacagacctgattatcaacaaaggagctactgttaccgcccagggaaaaatgtatgtagataaagctattgaactggccggaaccctgacattaacaggcacccctacagaaaataataaatacagcccggcaatctatatgtcagatggatataatatgacagaagatggtgccacgttaaaggctcaaaactatgcctgggtcaatggtaatataaaatcagacaaaaaagcatctattctgtttggtgttgaccaggataaagaagataacctggacaaaaccacacacataccgctggctacaggtttgctgggtggctttgatacttcttataccggaggtattgatgctcctgctgcctcagccagcatgtataacaccttatggagagtaaacggacagtcagccctgcaatcattaaaaacccgcgacagtcttttgttgtttagtaacatagagaattcgggtttccatactgtgacagtaaacacactggatgccactaatactgctgtgattatgcgggctgatctgagccagtctgtaaatcaatcggataaactcattgttaaaaatcagttaaccggaagcaataacagtctgtcggtcgatatacagaaagtgggaaataataactcaggattaaacgttgacctgataacagccccaaaaggaagcaataaagagatatttaaagccagtactcaggccataggtttcagcaacatgtctcctgtgatcagcacgaaagaggatcaggaacataccacgtggaccctgaccggatataaggtggctgaaaatacagcatcttccggtgcagcaaaatcgtatatgtccggtaattacaaagccttcctgacagaagtcaacaacctgaataaacgaatgggggatctgcgtgacaccaatggcgaggccggtgcatgggcccgcatcatgagcggagcaggttcagcttctggtggatacagtgacaactacacccatgtgcagattggtgtggataaaaaacatgagctggatggacttgaccttttcactggtctgactatgacgtataccgacagtcatgccagcagtaatgcattcagtggcaagacgaagtccgtcggggcaggtctgtatgcttccgctatatttgactctggtgcctatatcgacctgattggtaagtatgttcaccatgataatgagtactcggcgacctttgccggactcggaacaaaagactacagttctcattccttgtatgcaggtgctgaagcaggctaccgctatcatgtaacagaagacgcctggattgagccgcaggcggaactggtttatggggccgtatcaggtaaacggttcgactggcaggatcgcggaatgagcgtgaccatgaaagacaaggacttcaatccagtgattggtcgtgccggtgtggatgtgggtaaatcgttctccggtaaggactggaaagtgactgcccgtgccggtgtcggttatcagtttgacctgctgaataacggtgaaaccgttctgcgggacgcctctggtgagaaacgaatcaaaggcgagaaagacggacgcatgctcatgaatgttggtctgaatgctgagattcgcgataatctccgctttggtctggagtttgagaaatcggcatttggtaagtacaacgtggataacgcggtgaacgccagcttccgttactctttctgataaaaacaagggggccgctttatggccccctcttatattcaataaaacaaatataaaatagcgtgctccggagaacaccgtgttttacttgcagaaactctgtatcgttccggcggactcatattgacgcgtttttcgggcgcgtcatcggcggcgcatacgcccccccatggaacgtagtactcaccagtgaataagcgtcaatacggcgctccgttaacacttacgaggagcaagcttgcggcaacggctttccaggtgacagtagcacggagctttccccccggagaacgccggcaagccccataactgacttcgcttatgttgtaaacacgtcaaagggtgattatctgaaccttattattgaaaccaaaaatgttgatggcaaacgcgaactcagacatgaagagcatgataaaataaaacacgcacagaaactcttcgaacaaatcagtaaatccataaagataactttcatgacccagttttcaggtgataaaattcacgacctgataaaaaaactggcccagtaaacacggagagttatttacaataacaactctgccatcactgacttattaaaaaagcgccacaaaatgtggcgcattgtttcattacactatttttactactggccccggggacccgactgatgctgatgccatggcgcgttcgcctggctgtgtgtccctgatcagacagagttgtggctgctcatgctccgcgacctcccatgcctgactggctacagttgttgagccggcaccgtgactgaccagccctggataaggcggatatgtctccgttcttaccggtttcagtatccccgcacagcctgcaagaaacagcagtatgctctgctggatcgcatgacggtaccgggatgcatcattcccttcaatccactgaatcagtacgtcaagacagactgacttaccggtgatttcaaaacgatttctgcaccattcagccataatcaatgctcctctggtaaatgaagagggcactgtcccgtgaggaacaatgccctaacggggtgaatggcggtcgggttacaccctccgccagcggttcagattaagcaaccggttatcaggaataacgacttgaggtagcctgaaaaaagaaactgcaatccagccagcccataaactgcgacacgtcttacagaagatggatgtgtctttaccatcaatattctcctgcttcaacaaatgaagcagggaatatcgtcagaaagcaacaggtcgtgaacaaataactctttttgtattctgtaaatttctcagaagagaaaaagaattaattgtcgccaacgctttcaacaggtcgcatcatcaacagatgacaacaaccggaaggacaccgcgatggagttgactgcagacctgctgaaaagccttaacaatataagacaaaatgccaccatatatgttcacgcataccactatactgatgatgaaaaatgcgttatggcaccacgctcatccctgccctctctggagctaacagttctgcagtcagaaaaaattatcgatctgcttctgagtggttacggttatatcaggcatgacggctatgttcagggatatggagaaaaaactgtggcaactttcacaatacaggagggtaagcaccatcatttcaggacaaatctggcactgaataagacgggcaatatagccgataatgcgttgaatcattggctacatcgtatacgtaaaacagacatcattgttctgtctgttgttcttacagaataaattcagttatttactggaaatttataaggtctttatagttatccgccgagaatacccgtatgaaaactaataagaaagacacaaaatggtacattttttaccgtgaaaattcaggcgaggatattttgcttgaaatgtcatcatttaaggaatgtctttcggcatccaaagaattaatgaccccatcaaattacatgatatgcatagaaagaaatggcgaaagaataaaacgttgggacagggaaatcatagcaggctctaacaaatggattaactgtccacctgataacttcgaaatattaggtgagctaataaccattaatagaattatcaaaaagtaactccgactttagacaatgcattaagcaatgcgctataacaagcaacgggttcattttttgcgggagaatgcttgtaagtcatcgctgtgcccgggcattttcccactatcttttgtaaaatacctttaacaaatcttgattcgtgagctaacaaagatacccatttatcgatttcacattcgttatcaagtgtaaaaaccagacctttaaatttttccacttcagagaacgaattcatggtttcttcattgcacactctcctctgtatttccataaaataaatcatattatcatcaatcaacatccttgatatcagaaaacctcttatatctttcttattcacaacatcaaggtaaggccagttaagaatcgacttggaaattttatcattttccactttgctttcattgaactccgggattgcaacaagttcaggttcttgcgtatttaagaatgagctttctggggtataccagtccagagacttaattctttcagaataagctcccctcaaataaaccatagcattccacatgtcacgaacaatcccttttgactccatatacaatctttcaggttcatttttatcagctaatgacatatatcctgtgcttatgctattttgctcatcaacaacttcatttaccgaatataatgagtgtaaatcactttcattttttgtaacggatatatattttgctttttttctccttaaaggactcagttcacaaccatcgtcaagaaattcaaaaactgacgcttcaacttcaagagtcgacgctccagaatcaggagaaaaagcgttatcaacactgaaaggttcatccggattttttatatgccgaactggaacattactccaggcttgcctgctcccttgttcagctttttcatcaaccaggttactgttatctctgtcataatttatagtatatcctgcaggcaaagaaacacctgtaacagaaagcccaaggaaagtaacattattttccaaccaaaatcctttaacttttattctggcctttcctttaaaccagggagccactttgaggtatattttacgatcttcacatacatctaattgacgttgtattctgtcaatcactttccgggtaaacccatcaagggcaaagaaagaagcaaaaggagcatcatatttattcattctctttcttaattttatataaaagattttgtctccctccacgtatgcctcagaaaaaatcctgttacgcagttcatttcctgaataagtaagaataactctcttcaactcatcggaatgtccatagcaacgataaaaaaactcaagcggatggatgatcaccttatccgcatcatctgttaaaaactcaaggagccaatttttatcatatggagatttcagttgataatctgaaaaatcataaggtaatgacacaccttctttatatgcctgataaagagaattaatcttccaccctccatttgcataagagaaatcaacattaaatattttttcctccatcagaatttcagcaatacaccttcctcttgtccagacactgcctattttaaaaaaagacaaatcagtcaacagacattcttgctcataatatctatcacaaagagttccatcggcctgaacttcccgaaaggtaattgctactttaggttgttcacctcgtcttttattcttttttaagaaaccataccaccaaacaacccaggatgtatcagaaggaagatttaatgaaggaaaatgctctgtcctgttgatttttcttattgatactttttccatacatctgtccctctaaacaacagaactcttatctcacaagcaaatgttgaagataaaatagttattcacttaaaccagaaacgctctgatgcgaactacatccagtatatattaataatcttcttgccttatgctggtgaagcatgattacacatcaaatcatattatcacttatcacaggaagcccattaatagcatcattccactgaacctttctattttcatcgttaatgattttactcacccatacctctgtgcacccccagcgcgcagccaacatcttgttgctccagcctttttcttttattgtcttttttacattttcaggactaagtcctccattaatccatttttcaagatgatgtttatgaataacaaagtcaaactcaggatatgctctctctaaatcctccagtgaagttttcttccacagtggattcctgtttccctcaaaagaggcgatatgaaagtgatcattcagaaacaatgattcattatggttatagtattcaaaccatattgaattagcatttatgtaatcccataattgcgaatcaatttctttatctactcgttgtgatgtttttaatatatccagaaattctttttgctgcgtgtatgacaataccccctccctgaagagagcattaaccgcagcctctctgacctgctcaattgcatttgttactgacgtacgataatagttcaataattgagcgcatgagaaaacaataaatccatgtttaatctgaacccttaaataacagtacccattccggccatgaaaaccagaaaactccaggggcaaaaaagtcttatcaaaaccatccattacattaaacacaaccttcattgaaataaaccccagtttattttttattggcacttgcaatccttgagtttaaaaaacaagagtaacctgtcaacaccacttacataaccataaaaaaaataacaaaaattgacccacagatgtaataacgccagtcctgagactggcgtagtgataaaaaatgatcaggccgctgcctgttcctgaacatggcgcagacgatatgaccagtttccgaggtaatgcccgggcgtcagcagaatccggcgccgctcattacacagcgagttaccaatcaccacttctccggccacaccacacagcgacaattgtatatacgccataccagctgccagcgggtcaatgtccgtttccgacacccacatcctgcggtatgccggataccccgaacggttcagggtgtcagccatagccagaatcatactgccggcaccacaggcaggttcactgagcgtgataaagggtttgttctcaaacaacgctttcacattccccagctgcatctgtgccatcatgcaggccacaccccatggcgtgaaaaactggctccggtatttatcccccagctccagctgcatgaacacgctgcccagaaagtcgcagaatccctgctccagtccctcaatgacatgggcaagcaaatgcgccatgttgataacatcctgcttttcataaccactgacgattcgcaagtacttctgctcccgtgcttcactgaactgaagccggttctccagggcaatcacactgcagctgacaaagtcctcaaacaccttatgacgtttgtgataacgggcagtctgattaaacagcaaaataaaagctttctgatggtcgataaaggtggtcatgtgcttctccataaaaaaacagggaacacatggccccggggaggaacaagagttccccttcgggctgaaatgatagatgacaggaaaaaacgggtgccgcgaatgtggcaccctgaggttagttactggcctgcagccagcggaaccggtaaaggcgcggcttctgtctgttcttcagcgcgctcctccaccagatacagccggggctgtggaagtttttccctccccggccattcggcctgcgggtcactgtccgtatgttcaccaccgtcataacagttgtaaccctgtatgccccggacaggttcgctgtaccagtgccgtatctcacagtcgaacaccttcgagatttcaccaaccagctcacctgaaggcggataccagggcgtgtctgtcagcagcaccagactgctcatctcatcacgcacccagcggacattgtgacctgatggccactccacaccgtatatccggctgtaaaggctggtcgtggtggaaatgccctgcagcagtccacctgaaccgttcagctctgtggccagacgggggggtatgaccatcagcatgtcacagggctgcgcctgttccgggtaatccgacagccggctccagcaggcttcggcatcaatgtgttcactcagtccgaccagaccaaaccagtcagaatactgacaatgcattaacgtggtgattatctcccgggcattatccggcagattcccccagcggactgcgccaatacatgactggtgataaaggcggtcaatggtctttatcgtctcttcatccagtacggcatcttttaccagcagccccagccactgttcaaatgcctggttagccggagatgacatccccgtaccatgacgaaccagcgccggatatggcggatactgcgtcgtccgggtaggtttcaccagtccggcacaaccgatcagaaacagctgtatactctgctgtatggcatggcggtaacgcggtgtctcacatccttcaatccactgcgtcagcacatccaggcagactgacttaccggtaatttcaaaacgatttctgcaccattcggccatattcaatgctcctctgataaatgaagagggcattgtcccgtgaggtacaatgccctcacgggaaaagcggagttgtcacactccgccatcgtcaaaagtccgtccggttatacaaccttccggtatttactggtttctgcccccatttcgttgatagctacgtcgatattgcccgggaaacgatctgttttaatcttccacaaatcgtttttccagtaacgtgccactctcacatctggcggaacgttgctctgcccgtactttttacgaagccggtcaatgcactcctgcacaaattcattactgaatttgcgggattcgtgcacgaacctcagcccgtttttgccttcaaacgcacgggtaataaaccgcacttcagcctctgttggtccatccagccaggacacattaatcatgttgtaaacgccggaatcgcataccttcagcacgttaaatttctgccccggaaatgcgaattccagaacgtcactgacacgggcaaccacggcatcgtcaacctcagtcacagacttaacattcatcattctgctcctctgtatgaaaatcactgagggaacagccccgtgaggagtcgggccctcacgggatggcggtgtgtcacaccgcgttactgataaagtctttcagccaggtggtatgcccgaggccataccgcctgctggcattcataagttcgtctgccgacggatttatgtaaaggttgtagtaccagagttcttcctttaaatccgccaggttacccctgccggtcgcaagccactcctgcaccacttcatgaatttcagatgtgacgtcaccgcggtaattcgatgtgatcgtaacatccgtcagtaacccggcaatactgcccgccagcagacgcggttgagacatgccgttatagaaccatacgctgcagccggaatctccgggtaaaatattcaaatcgggtctcatgaaatttctcctgaaaaagcagggacccgtcccacagggatgagtccctgtggggatgtaaaaaccgttaaaatgcatcaggtattgcagcgtaccgcttcccggtactgatactgtcagcccagatactgtgctctgtttcatgtcccagagacataaccctgtcgagtacctcgtggaaaatcgttcccggtgcaggaacattttccatctccaggtcatacagcaaccagcccagagcctcaccaacatcccacaaaatcgagtaaagtggtgaaggctcatcctcatcctccggcaccggggtaattccgagacgttgccaggcgcgaagtatcgccagttcaccttccagctgacagagatgtgccagcaaagcggactgactctgaagatgccagtaaccagtaataaaacgcgaatacataaaaccccctgtctgattctttctgatgaaagagcacaccgtccgaaggaacgatgccctccgggcggtgaacaacagagttcagattgttcacccgcgattgttaagcattacgccgctttttctgccggcgtatcgtgtacggaaagaaggtattccgttgcctctctggcctgtcgacatgcactgaacagcgcttttttgtcagcacgaagaattttcagccatgcgccaatataattctcatgctgcacatttccggtgacacccagttgagcgcacagaaaggcactgcccatttcggcgataagctcttcgaacgcataacgttcatcgccatagctcccaccggaggaaactatcccttcccggttaagacgtttcgcatgaccggtactgtgtaccagctcatgcagtaatgtggaccagtaatcttccgctgaagtgaactgtgacgagagcggcaggacgatacgatcaaataccggggtgtaatacgcccggtcctgaggtaaagaatgaatcttcacaccgcaggcattcaccatcgtcagtacacgatcagccacagcattcagcgtgtcgttcgcaccgttctcagtgacggttgtcgccacctccggcagcgacaatccatcacactgttcaacgttaaagagaggattcgctttcagcaccggtacatcaaccataacggggttaccctctgcgtcgaatatccggttgccgttctcatcctcatcctgcttatgccagcttttgtatatcacggccattgtggacttctcgcccttacggacctgcccacccagcgcctgagcctgacggtacgtcaaccagcagttactgctgtaaccggcttcttctgcggcgagccacaacagcaacacattgatcccacggtaagcgctgcgtgtcagtgcattaaccggcatcattggatcgccgctgtgagtccgtactgagcgccatggacgtttccagggggctacgcccttttcgatggcctcaatcaccctgtccgtcaccaactgatacaggtcacgctccggggttttgttcacgggagatgaagtatgttttttcgttttcataagagcacgctccataaaaaagatgcatgctccccgtacggtgaacatgcaccatacggttaaattaataacgaaaatcagactggccagaattaccacaacgccagcatcaccagtgaacgacgttcaaaatcaaacgtcttcagcgtatcgctgacccacgcttttacgtcatccacgtcataccagtaatcaccggcatagtcttccccccgtaaacgcgagcctgtgacataaggaaacagcctgtggcagttccccggtgtcagcatactgaggtcgcgcaataatgcagccagtgagcggcgggttacagggaaagcatgctgctcatctgaagcaccggtatgttcacgaaaccatgtcagaagcggtttcaccttacggaaagcccccacctcctgatgttcctgtgtttccacaacggcaccattctgatggttatcacgagccagaaagtaaatatcgagtcccataacaattctcctgagtaacgcagggactctccccacagggatatgtccctgccgggttatataatgacggaatacgtgacgacgtaattccgggtaaagtcagggaaaacaccgacgcaggtacacggtgcagtaagtaaaagaaaaaccgttcagtcggcgtcggaaaagtcaatacagaccgccttcaggagaccggctatacgttgatccagacattcagtccagccatcgttccatccacgctcccatggattgtagacatcctcccatggattgcagacatcgttacagccattcttccatgcctgccataccgctatttccatgacagttcccagcctgtggcctttctcacgtatatgccacagaaacggccggaaaagtcctgatttcagttggtcaccaccgctttcgtagcccagatgacgagcaatactttcaagatattcaaaagcatcattctgcattccagccgccttagctagcgagctgtacgcatcacgaagtatcgtcataccttccagttgatactcacaccacgtacggacagacgacactggtgcgattacctgaagaatggtgcaggtacggcatacaacaacgcaaaggagtattaacagactattcatgtgttcacctcagataccaaaaaacacgggaacacacctgccctacgggacacatgttccctacagggtaataaggttaaaaacaaggacagagaaataattaccaccatgcccagagcaacagtacttttcgttcaaaatcaaacgaatcaagcgtgcttctgagccacgatttcacgatctcaacatccttccagtaatactggtcatactcctgagaaccaaaaaagaatccttctgttgtggggaagaattcccggcagttctccggcgtaaggcattcaagatcgctcagtagtgcctccagttccgttctggaaaccggacgctccacggcattttcaaccggtccacaatgcgtctcaaaccaggcaatcagtgggttaaccttgcgaaagtaccccacttcccgcgtttccggtaccgataccaccgcgtcggtaacacgatcacgaccaaggaaaaaaatatcgagtcccataaacaatctcctgataaaaacagcgggaccgccccccgaacgggagcggtcccggacgggttaaggaaaaatcagatttgccatcgcgcacgcgtggtacggtcagacagatccgggcgttgtgtgataaacctttcaacggtcatgacgaccgttcaacaggcttcagcgaagaccgaaacgatagcgaaaagaagtaagctgcgcggccatacgggaggcagcagagagcgtgcggcgagcggatattcgaccggtaaagacattaaaccgcacgacagacagcggaagtgcctcaaaccagtaacgatattcacggctgtgagaaccttcacggaactcaaagcagtgtcgcaatgcaccgttggtggaaacaatgcaggctctgactgacagattgccggtggcgttaataaaccacggagtgcagtacagatgcctcagttgtggagcggaccagggctgttgtgggtgaacacaacgcttctgattaaacagacattgtctgagaagatgaaagaggtaatgctgccaacttactgatttagtgtatgatggtgattttaaggtgcttgcgtggcttccatttccatcagatgtccttcctgctccgctactgaaggcgtggtgcgtaacggcaaaagcactgccggacatcagcgctatctctgctctcattgccgtaaaacatggcaactacagttcacttacaccgcctctcagcccggtacgcaccagaaaatcattgatatggccatgaatggcgtcggatgtcgcgccagtgcacgcattatgggcgttggcctcaacacggttttacgtcacttaaaaaactcaggccgcagtcggtaacctcgcgcatacaaccgggcagtgatgtgattgtctgcgctgaaatggacgaacagtggggctacgtcggtgctaaatcacgtcagcgctggctgttttacgcgtatgacaggatacggaggactgttgtggcgcacgtcttcggtgaacgcactctggccacactggagcgtcttctgagcctgctgtcggcctttgaggtcgtggtatggatgacggatggctggccgctgtatgaatcacgcctgaagggaaagctgcacgttatcagcaagcgttacactcagcgcattgagcgacataatctgaatctgagacaacatctggcaaggctgggacggaagtcactgtcgttctcaaaatcggtggagctgcatgacaaggtcatcgggcattatctgaacataaaacactatcagtaagttggagtcattaccgatgaaagaaaggcgttatgcgcatatctgcacgtaacagaagtggtataaacatcggaacctccgaatgaaaaagacggacgttccgccctgacggactggaaaatccgtcagggtatgccagcagaacacctggcacagtcaagttgtcataaatgcaaccggaaaaaccggctggaatatcaacgtacctcaatcaccagtagtgatatccgtttccagaggctaaacggatgtaccgccataaaggcatcctctttcaggctacgaggatattgcaatcacccgaaggcgcttctctcagattgctgaagcattggctggcagtcacccgaaggcgttcctctcagactgctggaacattggctggtcgccaaagcgacagtgatcacccgaaggcgtccctctcagatcaccaggacattggatggtcgccggagcgacaagttagcgtctaaaatataatcataaacaacataaaacttcaagttgttgtcgtggatctggtaataacctacaactgactgacaaggccagctcaatttgatattttttaattcagtaacactctttataaacctgtaagagagatgtaaaaatgaaatcgaaatacaaaaaattaaaagatgaactactcagaatagccaaagcatgcgccccgacaccagaagatatgttggtatatacgggaagagccagaagacttgcttcatttcttaaagatgccaatatacagataagttcagcaaatagaataaaactacgtcatattgaatgctattttcaacaacgttatcacactggcgtcagttccaatatactacgagaagaattagatacaataaagcatattctcacccattgcggaaagagaaacatcgttaaaaatgaacgactgacttatacatcactgaatattgcagatgtccgaccaattataatctgcccatactgtggaaataagacgaatcttataaaagggtctctcatgacatattccatgtcagcagcgacagaaaacaaatattactggatttgtcccccatgcaatgcatgggttggatgccataaaaactcagggagaccattaggtactccggctaaagaaaacctgagaatactcagaacaaaagtacgtaaactttttgacaattatcagcaaagaaccaacatatcccgtaacggggcaaacatatggctatccagaaaactgaattgtcacattcaggaatgtcatattgggtattttaatgaagatatgtggcgcatcagaaatcatcataaccgaaattaacaaaaacacatatcctccagattcattttaaatatcagctctcatcagaaccgttaaaataaacctgttttacataacgacctcttccgtcaccatgaccaagatccatagaaacacgagcgtagatttccgactctccatatccattttttcgataaaatcttctggcttcctgagaaaaatgataacgcatactgtgcggagatttcactcctgacaatcccgctttacgggcatgataacgaaaaacattgatagcctgttttatatttggacgatcaataagttttccgtcgtgttcatccattatttttgagcataaagcaaagcatgtcttaccgcatctctgtcaataattgtggtatttcttggtcttccacctttcgtaccaaaaacgaccaaaagagaatcgcatcctgaattcagttcccgtagccatgactgaacagacttacatgactgaactgcttcttttgttcttaaacccagaacataagaaagctgcattgctgctgccacaccaggattctttttttccactttagcaaatgttttccagaactcatccggtgacaatgctattttctttccatcacggcatgtatcctttaggccgagcgcttcattactcaataatgggttagaaggatctgcgattttaagtcgtccatctttttctaaaatggcacgcattaccgcccgttcattctgaatagtccggtgagaaatacccgctgctttcctgctgagaaggtaaccagaaatatgtctggttttaatactgctcgtctggcgaagtttaattccattttcgcgtaaataattcaggaagtactttgcaattctcattctgtcagctgttgttgcgtaactgccaccacactcacgggcaagtgagatgaaagacttgcgaaacagttcaactttagaacgtgacgatttccgggccataaagtcattctccctgtaaaaatcagatgcagtcccccttccgttcacaaagtaaaactgcatacgcagcccttccggtaaacagaaaagttcgttgatattgttagtttttcgtcatcacggacggctctgtaacgcggttgctcgccttcctggctcgtttgatgtcgatgtagcagagcttgcacatgttgagttcttacaggagttcgctacctgtgcaccagggcgattgttgaggaatactccccgtcaccttacgatgacgcctcccgacatcagaacgatttttcatttttattcctttatttcagtcagttaatacacttacctctcatgtattacgaagtttaaaaagacattccggcgtggtcgtccgtgtgaaaacggacgcgccggaaaggcgtggatacgtcactgaaagacgttgtcagagcgacaaaacgattatcaggacgcttgtcacgagcgacgattttctgccaggccttacgtgatgctgccttcagggcagatggccgcggcgtcacttggtgttcccttcggtcgcacgcaagtgacgccgcacagcttcaaactccacatgcacacgcaagcgaccaaatttcaaatggtcttatgccgtgcgcacagtcataagaagctcatgcggaaagtcagaaaatatcttaagacgcagattttaaaggcgtttttatgccagtctgccgggaatacacagtagtccggtagcccggaaccaccacggtaatccgaaggaaaaatcaacgtacctccaccaccagtcctggtgatatccgttcccagaggctaaacggatgtaccgccataaaggcatcctctttcaggctacgaggatattgcaatcacccgaaggcgcttctctcagattgctgaagcattggctggcagtcacccgaaggcgttcctctcagactgctggaacattggctggtcgcaaaagcgacagtgatcacccgaaggcgtccctctcagatcaccgggacattggatggtcgccggagcgacagttaatgcagatgcaggttaacaaaaagggaaatctaccgtcaaccatatgaacatgttgatttcattatgaatgtgttgttttaatataaattaatcggtaacgtcataaaaagaatataaaaaacagataaagcatgcatttacacacatatcagtacaatgataaattacctctccaaaaacacgacgaaggtataatcatggaagcatcaattatatttttctgggttatctatgctcttattgttatctcattcttaaaatcaataataaccgacacaataaaaggaaaaaataaaacaggcgtagcattatatatatcaatccttttatcagtcggatatacatttcagtacattcacaattacgacatattttcagcgtcatggggagttggtatatttgttactataatagtactgcgcatagtatttaatctcttatgcattctgtcgaaaaggatattaatatcacgccatataagaaagatgcaaaaaaactaaaacatacgtctgtgtctgattttatttattatttaatgaaaaaacacaacaaatatcccgtgtatgtattacatataccatcaaacaatacaatagaaataggctataatataatgaatgaaaatctggtcattggaaaaggaatacatttcaggacactaagcaatcgttctttatatttcaccctgacacaacccccattaatcgccacaataaaagatgatgtattttgcactcttcatgattactataaccacaataatgaaaccaaatccaccattgacaattatatatcaaaaatacaggataatcataatacgccatggatattaaacaatgaaaacgttcagaaataaaaaacaaagagacaactatcaggataacacaaaacagcattatcacatgaaccggagattctatttcaaaaacatcctgtggggaatgtgccccattataatatccatattacatcttatgtatgacaccccaacagaagcgtcgataaaagttgacttatttctgatactcagtggcctggcccttccttgttcaatatacctgacaaaaacaatcacactaaaatacacatccatatcattctggaaaaaacctcttttctggtcttatggtatatatcattttcatcttgtttatataatgatatgtatagttttagcaataccttctgcaattatcgttttattctttcacttttatcaaaacatcaccagaaacaggaaatgacaaccgcaataatgaacataaaaaggcaaatcagaatggcagcaaatcaataaagtaccctttcatatgaatcatcagaaaaacggtggacgcgacatccggcacgaggcaaaaacacagcaacaaaataagccggatatcgcgcccgttacttttgtaactcaacttcaggcattgtgcaagttttgatctccgggtggattcagagccattcccccattgattcaggctgaaaactcatatattcttggagaagactggaatctcattgctgtgaaattccttacagaatattcagccccattttatggggctttttttggctgccccctggctgttaccacaccttcgtgatgtgaataaaaaagcccgcagtttttacactgcaggcttcaggttttctttgtgatttgcatgcaagggtgcgactttcgactgtccctcaggcaaccggatagcgggggctttcacccccgctgcggtttcttacggtttacactgcaagaacgccgcaatttccgaccacataaagcgtaccctgaattcacacggtgatgcgtgtaacacccagacggtcagcaacatggtcaggcataacatgcccacaatgatcgttttttgcggcatagcacttgctccttttacagagaggcgctaaccttccacttgctgaaggtagatggtcagggcctcgggttaacgtttaagttgactcggggcctttccacatccggccttcaggtaatccttccagccgtcagccgaaaggcacccgcgcgtaatgtactggttttcagagaggtccgcaatcttccggtgacgggatcatctgcacactccccggtgggacgggctaacggtatattcaggtgcaggatctctctgtccggtgcgtttttaaattgttaaacacacctttgcgactaaatcagccaccttttttcgcatcaacaaaacgcccaaaacgctgggtaaagcgtgcaacattaccttctgaagcgacagttctcagtttacctgtataaaacggatgcgacttagaagaaacgtcaattgtaacatatgggtaagttaccccatccagttcaattacccggtcagttttgatcgtcgaaccgatcctgaagtactcatcaatactggtatcgtgaaatactactgtacggtattccggatggatattcggtttcacaacagttttccccctttaagtgaaaattccgcataaaggtacatattcagacggtcagattcaactgtctgttcttataacctcactctcttttagtattgcaatatgttatataattataaactggacttcccgaaaaaaatccattaaataagaagcgagccgttgcggaggcttgctctctcctttaacctcatgtgcaatatccgtaacgcgctcacataaatcatcatctgataatataacaacacccattattttattctgccctaaagacttcttctaaaataaacgtttacccgacgtatctgatcccgctgtttttagctgtatcctttaacatacttgagaagcccgctgaaaaaatataccgtaaaggcggtttctctgtcttccataaaactgtcggataagaagggcattacatgaaaaccaaaaaagttatgatgattgcactggtcagttctgcgctggctctttcaggatgtggagccatgggcacagcgatcaaaaaacgaaatctggaagtaaaaacccagatgagtgaaaccatctggcttgaacctgcgagcgaacgcaccgttttcctgcagatcaaaaacacgtcggataaagacatgagtggactacagggaaaaattgccgatgcagtcaaagccaaaggttatcagatcgtgacttccccggataaagcttactactggatccaggctaacgttctcaaagcagacaaaatggatctgcgtgaatctcagggatggttgagtcgcggctatgaaggtgcagctgtcggagctgctcttggcggtggaatcacagcgtacaataccgggtctgcgggtaccactctcggcgttggactggctaccggtctgattggcatggccgcggatgcaatggtggaagatataaattacacaatgattacagatgtccagattgccgagcgaaccaaaaccagcgtcagaacggataatgttgcagctttgcgtcagggaacatctggctccaaaattcagacaagcacagaaaccggcaaccagcataaataccagacccgggttgtatccagtgccaaccaggttaatctgaagtttgaagaggctaaacctcatctggaagaccagctggcaaaatcaatcgccaatatactctgatataaataacccggaggccattcaccgggcctccggccctcttagtctcaactttcagacaattcagatattatttttcctgtcacaccatatacccatgcaggaacagaatctaatgacggtacaagtaaattcttcagcgttcggtttgcctggcgcccgtagctgtatttgtgcctgtttcttcttatacaagagcagtagtacaatttctcttccagagtcagttcaaatttaggacgtaaccaataaagatctcttccactataaaatggtgaatcctgtacaaacgtttccataactgaacctcctgctgccacagttaacacaccggctggcaatgggctaataccatctattaatttaaccctggcggaaacaccattattttttgacgttcttgaaacaaaattgattcctgaagaatctttctccagtttattgagctcaagattcagtccataattaacatcaaataactctgataaaggtatcagtttctgttcaggataattattaccatgacgacaacagatattaaatccctgcacattacccgacatcaggagttcaaaaccgtctctgacctcattcatactggcagataaattcattacccagtccggtattatgtcaggaagctcaatgtgttttagtcttttccctttgggtttgcgaccataagaaaataaatatctgttcatagttatacaacgagagtaatatattttttcaaacaatcccatatcctttttaggaataagaacagaaatatcagtattacatacaaactcaaatgaagaaacgtaggagtagctgtgacttccttccccattagttgaaacaaatagtgcccctgcaggataaatattacattcatcaacagaagcacggttaatccatccggcaatcgttctttcctgtgtgctcgcgggacgaagaacgggcactgaatcaggaaatgaacaatgacagactttcatccctgacatggatataccatttctgatataaaaaagattacccagcaacatctgcagcctccggatcattatgtatatccagcatcaacttatataaaaagtatcgtttcacatctctctcaaatacttcctgagtaagagaagaataatctgtttcaatccatgcttcagcacaccactcatcattttccgttatcttatgtgcagcactttccccgggaatgatttccctgttgcgatacatttcaacccaccgatcccgtatcgatggccaccggttatataaatcggttctgcctttatgtttcgttttgacaaaaccatcatcacgccagtagccaaaccaggttttacgatcagagacatcatgaggaatccccgcaatccataccataatgcaggttacaacaccgacgggataaaagagttctgctggcatagacatcacagcatccagagtgtgatgcctgagcaattcctctcttaccggattcggagaaattgcacatgacataggcacaattgcaattccgtatgaccccggctccaggcaattaagcatctgcttcacgaaatataattcgtgtaactccgcatcactttttgcctgcgcatacggcggattcaacattcctacattaggtttcattttctttactgcacagtttattacttcatcaaagcaacttgcctgatgcaggtttgctttaccatctccgcggaggatcatatttgaggctgcaagagcaaacattttagggctattttcgatacctatcagacgattttttctgatatcctgacgctgctcttctgtaacagctttttttagcatctgttgcatcgctgaaatcaaaaaaccaccggttccggcacaaatatcaagaaccctggattccggtgtgacatttgccagtaaagaaaacaactcagcaatatgccggggagtcagaacaatacctaatgcctttttatctccggcagtatacttcagaaactccccgtaaaactggccgacaacatcaaaatcatgataaatatttatatatggccatactttctcaaaaatatccgtgataattttcttaaatacaccatctggatattccctggcaattttggcatcaggtttcccaagattaggatgtacagcaatgtaagtatatggctgaagcatcgtgtctttcttggcctgtgggatatccgccttatttaactccttacgaatggcatctaaccatgcatcctgtaactcattagcaggtaacgcgttaaacgttttcataaatgtcgtgttcattaacgcaattaaagtaccgctaactaacagaggtttatcttcttcagatattttcgcctttgcccagataagctcatggagttctcttgagaaatccagcaaatcattatgacgtttacgtgcaacttcgggatcaaatgatgccaaccggtaataatcatcaaaaggaagtaagtctgtcaccggcataccagattcagtaacaagcgttttaccttcatccgcacctgcggcgaaaagaaatgtggatattttcagttgttccttagtgatgccacttacggcaactgcaataacagtatatttttctgacaagaattttgcataatgcaatactccgtcaacagcaaattcaaccgggcgatttctgtcactgcttacatgctttctgacatctgacttacattcaaatataattataaactgcgtatcagtttgcgtggaaataataaattcaggatagcctgcgcctcctttagcagcttttccggcctttgataaaagcgatttgaccgactgaatttctgatttttgctcctccacagatatcccatttccgggcaaatagtaaccataatcacgaagtacatctcgcacaatcccttctgttattctctcattagccattctgataatccggtatgttatcagtcataaagcacgacagtaaaaatgttatacttgcgaacgacactgtgaaagcaacagcatgtgctggtagcttcatacggaatcataaaaacataccggattatcagtttagtgctaatcaacaggtacggcttaacttacaggaattccccgggagcggcggactcatcctcagttagcggcaaaatcgcatcacagccaatcgtctgtctcgattccccatcggcgaacaacgtatgtggccacaaaatcctggctggctcagaacgaagagcatctgagcaaagaggtcatcaatctggtatgaatatctggcagaaaatatcccctgaatccacaactgctgtgcatatctgctcaaatcagcatcaatcataaaccagtaatcacagcgcctgtgattgggttacaggaataagtcccccttcataaggcatatcatcaataccgatgaaggaaaagaaagcatcagatggcctgatagtctgcgtcagtcaatggcatcagtgctttatccggaacgatgtatccatgttggcgacagagaaagccattgccatgaacagttttgtttatccccgaaaagtcatttctgttacaaatttatatttacaaacttgctttcgatgagaaacatactatttcaatgaaatgcagaatgaggcaaaaattcgttatgttttttaattcccgaaagaataaatgtggcttattacagaatcctgttaatgttaactgatattttataatgcatattcagacatgtaattaaataagagatatttatggctaatacgcccactggtgttaccagaattattaaagcagcgggttattcatggaaaggcttatgtgcggcatggcgctatgaagctgcctttcgtcaggagtgcattctggttctgtcagctctgataatatccttttggctggatgttaactctgttactcgagtattactcattggttcggcaatgatggtaattattgttgaaataattaacagtcaattgaagcagttgttgacagaattggttcagaacatcacgaattatcaggcagagcaaaagatatcggttcagccgcagtgttgattacgattttagttgctatcattatatgggagttttattactctcataacgcccaacatctaaattattaacagttacctggttaatatttacttaaggataagaggtattcacctcttatcctcagtaaaatgtcagtatctatctgcaggaggatataatatcatcttctttattataaactgaagtatttacattccataccccagtaacgatgaaaatatattatcatgacttactgttctgtttagagcatgttctgacaaacaattcaaatcaatttttttagaggaaacgaaccccggagacatccaggtaataagaggcacatgcgtttgctcagctggtgcaacattatatggtgttccatgtaagtataatccattttctcccagagattctccatggtcagagacatataataaaacagcatcatactcatctttatattcgataagcttgtcaattaattttgatattatatagtcagtatagcgaattgtattatcataagtattaatcaattgctcatgcgtacaattttcgatatcactacgatcacatgttggtttaaaatatttatgtgactcaggataacggagatagtaggtaggaccgtgactacctatcaaatgaaatacgataagtttatcctctgagttatttattatatactcatcaatattttttagcataacctcatcataacatgagtttttcttgcataatgtattatctgaatttgatggctcaatattaattgtagggattcgcttacatacacctttacatcccccgtcattttcaatccagagtaaatttacccccgttctgtacagaatatccagtacattttccgaatttaccgctttacgggaattgaactcttttcgcttcatatctgaaaacatgcatggaacagatatggctatggatgtgccacacgactgcacattatgaaaggatataagttcattatatttctttgtaaaatcattggtaccacgagaatatccattcagagcatagttttgacttcttgctgtctccccgacaactaaaaacataattaccggcttttgtttttcatttattgtgcgggatgcattcgttccaatctgacgaaactcgccaggagaaacaaaaaaaaatcccttacatatttaaacccactgtagatataattagtaggtattatttctttatttaatgaaaagttgtttctgccaactgatgcataatccttataaaagaaaaacgcaatcacaaatataatcaagagagatgcaaacattgatattaaacgatatataatacccgttatccatgtctcaggataacggatatttactaacaacaatagtccacatggaagtatacccgtaaataaaaaccacagcgcaacagacatattgaaatatgatgtcatttcatcttcatttgtttcaaaaatattctgtatcattgtttatcaaactgcacaccatatttcatggtggcatatgtaacaatagaactacagataaacagaatacaaaaaaaggtttaagtatatacctgaatgagaacggtgtaaaaacaaaatttaatgcagatatcagaaagactggaagagatataataaatccaattttcacaccatcaaggttattaataatattaaacagatgcatccagacagggatattgaacaatgtggcaaaaacaacatctatcattaacatcaagaaaagaaaattaatactgatttttttaatcatcttacccccattaattagagcctataattgtcagtatctaaaagtgatatatttttataaaacccggtaaagtgaatactgatttataccaggtcaaacttcaacttcatcatcaaaactttatgtcaataaaggcgtttatagttactgattcttttattttacaacaccactaacatctttttaataaaaaatctgttcacaatagcatacacagaaattctctaaggtattatatcatcaggaaatattattattccattcatctctggaggcccccctcgatatgaaaaacgataccacacagaagtaaaaccacccgctatgcaggtggttctgacttcattctcagaaggatattctcacattagcccagtaacgacgtccttcatcgacctgccagttaccatcaatggtatcgatatcttcgctctttctgtctgtgacgttaagtacggcaaaattaatcagcgtgcctggcaggaactggtaattcataccaatatccatagaagtgaatccattacgaacacggggaaccttggcaccatttctttgtgctgcccagatttgttttcctgtataattcagagatgaataaaatgtaatatcctgagtgtaatcccattccagttttgcattggctgcatgtctgggagttctttccagaggttcccctttcagcgacttgccattgagactttcgtcatcgctttctcgacgggagtcagtgaatgtatagtttgcagatacacgccatttatcatacacaggaatctgagttgcaagctccacacctctgatatttgcctcacccacattatcataaataaaagtgtttagcccagtgactggatcttttgtgcctatatcgtaactggtcagcttatttttaaaatctgtattaaacagagtcgcgcttgctgaaaaaccactgtcattattataaataataccgatctcttcggttacactggtctccggtttcaggtccctgtttccatacataatagaggcaccaccctgcgtcagtgttccaaatccaggactgacctcacgaatcgaaggggcccgaaatgcttttgcgatccctcctttgagagtgagattatcggtcaggttataaacagcatacaatcttggattccagtaactgccatagatttcatggttatcgaggcgcagccctccagtcagggcgagagaatccgttgcagcatattcattttctataaaaacagctttctgtttaactgaaacagactgtgtttctgtcgtttttttacctgtggctgagtcatcacggagttctgcatgctgaaattgacctccgatggtcagcacattttccggcagaaatgccgtcacttttgcatctatgatcgtgttggttatttccggttttcttgactcgtaattaagatcccaatgattatatttatcttttttaccagatttaacctcacgaataactttctcctgataaacagcaatttcaggatgcagtatttcgccctgggcattccatgctgctacccagtgactacgtgagttatgtgtttctcttttactgtttggttgtttaagatttccccgcatagtccaggcatcaagagaatcaccaggtgttaatgtatgttcctggttattttttccgtattcaaaaacaaacttctggctttcagtcggagtaaactggagtgttgccgttatattcttattattttttgctggtgttccctgagagatactatcttccttgcgatagttcattcctccatataactgaagaccaagtttatccttaaccaatgggcctgacaggtagaagtcattcgtggttgagttaccaaatttcccatgttcctgaataattcccccaagcccaagtacgccatcccatgtctggttattaacaggtttggttatgatattaataactcctccgatagcatcggaaccatacagggaagacatagggccacgtataacttcaatacgctcaattgcttccacaggagggataaatccggcttcaaaaccgccgctgccgtttggtctggattcccgaccactctgacgtcgtccatcgaccagaatcaatgtataatcgccacttaacccacgtatactgatatccggtttttcattcccaccggtgatactaatcccttcaacatcttttaccgcatcgaccaggtctgaaaccggttttttttgcagttgctctgaagtaatgactgaaacactggccggtgcatttctgagttgctgagtgaagccggaggcagtaacaacaagcgtatcttcttttttatcagaactggcataacctgatgatatgactgtagaacatatcacagcaatgcccggagcaatgatacttttggtcttcataactttccttctaccaaaaccgtaatgataatgatttgcgttagcataaggaaatttacaatgaactgaaaggaaggtaaatcacatttagcccactcaggtaacaatttcatacaattttcccgagcctgtagggcaaaatccattaaaaaaatcagtatcttttactacttacacattactgcatcagtatacatgccggtaaatgacttcttttctggtaatcctgcaccttccaacgaccaactctcttcgtgaaccacactactgtttttaagttggtgcggctttttcagcctgatgtataagcctgtaagaaacaaagaatttatgtaaggaaaaggaattcaggtgtttgttgcgatgatagtagtctgaatgtctcagggaaacaaaaatgggcgactgaccagatatgggagtctccggtcagtcattcgcttgtagatgcaggacacataagcgaaccgaggcccactgcttctgcgcaaaagcccaaatattatacactgttagatttattatcaccagatgtacaataatcttggcattgacaaagccaatagcagtgatcttacaactgagctggcccccctgaaaacatttaaccgccgcttaaactgccgcactataacgactcccaccgcagggagccgttttcttatggatcttctcaataaccagcacaattccattaaacatccactgataccgcagccacagccctatgcttgttaacataatagccatgatgatgattgaacatttctcatacagcacgtatgatatcaccatgatgaatttctgctcaggtgctgcgatatgaaaaatcaaacagaaaaagcgatgtggaattgcaaaacctcggatacaccatggaccttcagttccctgctgaaaaaggcagtctgcgcgattttgccagatccaacaccggttcaagataaagaagcatcaaaaaacgtttttgagctgtttagttctgaaaaagaaagactaggagaattgccagcttttttagactctcgtacctattgggagtatcagcaatgggaagagcaaaataaaaataattaatagcgtttatattaaatacaaacgctatttcatttgttattttttccccaaagagtttctcactttcccagcgatatctccagcccttgagcctgcttgatgtgccacgcttgttccatctctagctgcattagtgatagctgcaccgacatttactccggcccaggataatgcccccagccacactgctggcaacacaataaacatcgtccccatcaccaggttcatgatgatatcgtccgacgtgttctgcagccccatcatattcagactcgaatgtgtatctgaaccatacagcgccgttatcatccagctgtccagccaccgcgccagttcccaccagaacgtcagaaagttcagcgcaaacacaacaaacgtcagcgtgatcagcgtactgaattcatatgccgcaaaagcaagtatcatcggaagcatgatatacaccgccatcagcagaatactctgcaccatcggcagcgcctgccgcatggcatcaaacgccggaaacgcccccagactggcgacagctgagcctgccgtggcgccaatacgtgaaatggcattcatcgtggtcatgtctgcattaccaccatatccccgatacacttctcccccctgagaaatcgtcaggttagccggactgaccagccgtttgataatctcctcctgataagtcgcctggctgttccccagaagcttcatcgctgccgaaagacgcagccacagcccttcatcaacttcctccgtaacccgctttttcagccccacactgctgtcgttccaccactccctgcacgttgggtaacctccgcgccccgtatccggacgaccgctgtcacgggcgttattccacggaaacgccgcccttggcgttctggactgcagcgtgccgtaatccccctgcatgaacgtgctgctcccaatccagctgatatccgacagcacctttctgtccttcgtcataccctggtcacgttgtttccactggtacatcgccagcgagtagcagtcattggtaaaatcctgcaactcatcggccagcgccctgttcgcaatgaacgtcctctgcacttcaaaacgcagttgccgcagatcaggcctgcagggaatggacgccacggccgcctgtgtcacccctttggaaagcttatgcacaacaacccaccagatcggggccgcagcagtcttatctcccagactgctgataatcccctgataaccggtgtccccgggggctttcggcgtccacacaccacaggtctgagcccggctgcgatcaaacttcagggtatccagcgtcacctgaaccagcggtacacaggacgccaccatcacaaaaaacgcaccatacaatgcattctcgatgctgggtaacgagagcatccccttgttgccttcgtccgccccctcttccctcaccttcagccagataccgatcactttgaaagccagaggaagcgcaaacagtcccgtgccgatcagcaaatcccacagaccgttattaaccagccagcccagcagggtcagaaaatattccagatagttattggtcgtcactgctcagtcccccgcggcggaaaaaatagcgtattcgcacagcaggaaaaacagcgcactgaccatacaaatccgcgcaaaacgcagacggtactctgcccggaatcccggtgcacgccagattttccggcatccccataccagcccgcagtaaatacaaaaccgccagcccagccatccgaaacgggtttcgtggaaccagagcctcagcgcatccacctcctgcgcatgacgcatacctgtatccgcaatcaggagcgctgacgccatgatgacaatcactgtcagcccccatttccccagcagtttcatccctttcacaagcagcccgacccggctcccgggcaccatcggcactgttttattcattttcaggaacctccagtgaacggacacggctgtcagcgttgtcggtctgctgaatcatcgggttattgctcacacgttcattgtcacgctcaatgatggtcagcacactgttacgcgccagatcccgtttcagctccatctcacttttcagggcgatgatctccctgtccaaagaggcaatacgacgatcgccttcttccagcgcggcaggctgtgcagccgcatacggttcagacattcctgtgagcagcattctgcgcatcaccagtgccgtttccaccgtatcagccatcgccagttcaccggccagacgggaggtcagggacatattgtccggatcgcgacgcagcgcatgtatcaccccggcagataccgccagactgccggtcttcagttttgccagattctctgccgtgggcttatcctgcccgttcacgaggcgaaccagctgttccgtatttatgcgtgtcgcctcctcaagcatcggcgaaaaccctgttccggccaccgccgttcccggctgctggtctgagtcaccactggtacattccttcgcatccgtacaggtgcgcattgaacgatcacccagtaccttcaccacagcgctggccgcctcctctgcattcctgaatttctcacaggcactgccattacagcttcccgcaccaacaccagatgtactggtcaccggcagactgttcatcatattaaaccccgcggccgtcatgtcatgaaccgggcggatggcgggctgaccggcaccgccacgctgctgaccaccaatccatttctgcccctctttccccgttgcctggcgtccggcgtcatcacctttaacggcatcaccgtcactggtattaacaacctttttgtactcctccatcatcgcggcctgcgtccacttgctgcgatcggaaaaatccatcatccgtttcgccatgttctggcaattgagctgcgctttgtcgaatgccacattcgcctgcagtacaccgttggtcagcatgtcatacagccccggattagcccgctgtatcaccattgccggcagactcgccacggctccgctcgccccctgaatcacatcccccatcaggtttttaaaaccgtcagtgatcccgttgagctggtttcctactgtggttttcagatcgaagttcccgcacatcagatcgctgctccagcccaggtccagcccgagcttctgcatattactgcgcgtcgccggctgggaaataacggagccaccgcccagggtgtaaaacagcttgtccgacaccgcaccatccaccgattttccgtaaccaaacgtgctgtcattcagttttggcagcgagagaatactgtctgccatgaccggcgtactacaggacagcatcaccatcatcaccagagtctttaccttcatcgtcatcatccgtctccttaaaaattcgtactgccaaggaatgtctgtccccgtttcttgcagcaactgtagggttgccagagcgcaaaagcggcattaccatcctccgcggcctgatggtctccgtcaggaaacacggcgcaggagcgggagacggagggcgtcagtctctgccacttgtggttacgggtgtccgtattttcctcaaccggatccggcggccagaaaccatcctttttccgggtctgtattgatttataaacatgtggctcaccggtccggctgatgatgtcagccacccgctgggcaaccacggccgccgccttgtcatcatctgtctgcatcacaaaacctgaacggggataaacactgccccacaggttttcttcagcctgactgccgatttcacgtttaccgggaatgagggcttccggatacagggattcaggcattccggtccgccagacgagactgtccagggtactcaggaaataaggcattgccggtgtcaccggcgaatcgcagctgaatcccggcaccattccgccaataagacgcgttgccggatgccccagcgcgtcggcatatttaaaacgaatggccgaacgacgctctccctgagctttcatatccgcaggatttcccccaccggcactcaaccccgctaggcctttcgtaatagaattctccacccctccggcagtctgactgaccagcgccatctctttccagggattaccacccggtgcggtgtaggtggataccaccacttccggaatataatgtgtcactttcaccgatgttctgaccttacagctgaacccggagcagtacagccagtagcaaattccgctgacccgccagctgatacaatccggtgctgccgcactggccacaatactggctgtattcagtgaggctgacgccagaggcagagctgcaacactcagcagcagggccccggcacgcagacgaaatgaccggctcatcatggctgaactccttcctgtgctctcagttgtgcggcctctgccacatccgtggtaccgtagaccacgtcacgatcatcaaagaccacggccggatatttcttcacgcccagtgaccatgcatgcgccacctcccggtaacgctcagccaactccgcctgcatcgccccccactccggggactgcatacgcgctctgaccctttcttcggcctcaccggcatcggcgggcaatgcaccaaaaaaacgagcctgcagttgttcaggaccatccagaaggatcacccgcacgtctgaaggcgggtttacaggaggatgttgagaatcggtataaagggttatgccggctgataccgccgtcggcaggaaaaacagggaactgaatataatccggtgcatggtacgcctccgtcagacaatatctgaatgacagcgtgcgcagataccagactaatagcagcaataaattaaaaacgcgtggataaaaattaatatgaagatgcatggtgcacaaaacggtatctgaacagaaatcagacaccgggaatcatataacgtagccactgaacatccaggagctgcagtggcaacgtatgctaccgtcagtgatacggttttatgattatcagaactgatagttcagtgacatccagtaatttcgctcaggtatcacatagcccgttgttgatgatcccgtctggaagtaatcaccggcataaagcgtactcttaccggcactgtacaggctcacgtcactgtaatccttgttgagcaggttattcaccgcagcattcagcgtcagggcatccgtcaccttccacgacagacctgcatccaccaccgtccaggctttcagatattctcctttctcatcatacactttcttctgtacagcgctcagcgacgaataattccgggtgaagcgtggagttttatcgcgatagcgagcccccagccatgacgcaacttcttcggtgatctgccagttcagtttcgcattcaccatgtgttcaggagtatagctcagcggtgcacctttgttatcaccatcacgttgttcacttcgggtccaggtgtaattcaacgacagagtgacatcctctgaccacagcggcaatgtgccggcaaattccacaccatgcaagcgggcctttccgctgtttgtatagctattggtgttatcatcaatggaataagagacaatcttgttggagaagtctgttataaagcctgttatattggcattcagaccggagaggttatcgtaatatacccccgcctcataacttacactctcttccggcttcagttcggggttaccgagtagattagtacgtccctgcccggatacaccgctgatccccttatgtaactgtcccatggtgggggctttatatcccgtggtcacaccgcctttcagcgtccaggcatctgccacatcccagaccagatatgcacgcggactgaagtgtcccccgaattgctcatgatgttcatagcggctgcccgcagtcagcgcaagtgcatccgtaagatgccactcatcctccgcaaataccgaccagcttttctgccggaaagtttcacctgtgctggcaaggacaaccccgtctttcatggacgaactctgatactcgccccccaccgtaaccagatgagattctcccagaggggtaagcagtaatgaattcaggataaagttagattccttaagctcccgcggctgaccggcaagctcccatttgtcgcgcttcagtacactttgtacaagttcacgacctttattttccgtctcgttccagttcagatacgatttccaggtaccgaaggtgaaagaatgatcatagccagctgaaattttgtttcgctcatagcgcagggtacggtcatatcccccggtcagactccccagctgcccgtcccggttatcataacgctgccgggtggtatccatatcaaaccagagtacatcctgctccgtggctttccagtcaagacgcgcaccaatattataattctgtgactccgtgggataaggaatacgcgtggctgctgtgtcgctcagtgatgtgaccgatgagccctgacgctgctgtgtgctgccccggacctgcagactgacagaatcatccacaaggggaccactggtccagaaattaaactggctgctgttaccccatttgttgctttcctgcagattcagccctgcattgacggaagagagccatttgtctgcattctttctggtaatgatattcaccacaccgcccatcgcatcagagccatacagtgtggacatcggccccctgataacctcaatacgctcaatggcggccagaggaggcatgaacccggtattcatggcagaaaaaccgttgggagtcacgtcactgctcccgccctgacgaacaccatcaatcagtatcagcgtgtaactggcaggcattccacggatgctgatttccagcccaccggttttacccgtaccactttcaacatccacaccctcgacagatctcagagcctccgccagatcgtggtactgcctggactgcaattcctcctggctgatcacagagacactggcggctgcgttagtcagttttttctcatagccggatgccgagacaatcatcacatcctctgcagcagccatgctgctggctgagaatccgaggcagggaatgatgacagaagccagagtggttattcgcatattaataatctccgatcatattaaccggcaagacaatacacaaatacaaataataatgagaataatttatatttactttttacaaaaactgaagattcataacaaaacaaaatatatacaacgactgcagcgacacgcctgttaacggctatctgcctgacagattcgattctgaatgtaaaaccggttactgcagaaacgtatgctcacagccagtcggccataaatgctctctggaggggcacgagtgaaatgattcagtcaatgagttcttccggtgaataccggataaaaatattgccgccatgtaataaatgtgttaattaaaaagcgcgtgtgccggcaggtatgaattgatcccgtaccccatctgccggttacacgctggcgcttatttttctgcctccataccattcagccacaacagcagatagagcaaatctgccgcatccacaacctggatataccatctcagatgcgtatactcctcctctgacggccagcattcatggccccccacggaaacaagcagatagacctttccggtatcaccttccagcgtcacagccacactgctgttcatgccaacccgctggggctggcatacaacacgacgcaactttcccagacgacgattaaggtgtgagcgcagccgcagaagatgcggctgtgttatctctgtcaccccgggcttaccctgtggcggcaaaaaaaacacaacgccacccggatgcaccactgtctgcagctccggctccggatatttcagatacatcatgccgcactctccacggcggaaagtccccgcagtctgtccagtttacgggccacatggaacgcagcctccagttcgctgcagttatgttccttcatcagcatgcgccgctcagccttctcttctttctccgtcatccccagagccagataaagactcggtggcaccgcacggaacagcgcctcaatcttcttcgccaggacacccccctccgtataacagccggacagtttgctcgccgacatcagcaccgccttctgctcctccgtcagggatttaaaacgggcaatgttgttcacctcttccggcggcatcgtcagacacacccaccactccgccatgttcagcattttctctgatatatccggatagtccttcaggttctgcgtcgcaagccacagccaggctcccagcttgcgccacattttcaccaccttcgtcatatagggcgagagcagcggattcaccgtcacgatatgcgcctcatccactgcaaacacaatatcacgccccagatactggtcacgttcagcgatgttgttaatcatattggtcattgacaccatcgtcagagccatctgcgcctcatacccctcacgggccaggtgccccaggtctatcagcgtcacatccgcttccggccacagttcgccttcacggttgaacagctccgcttcaaaactccctttctgggtgaacattcccagtgactccgccatctctgccgcctttgcccggcgtacctcgttacgtcccgcatcacaggagatttcccggagtgccacctgcaaatcttccggcagcatctgtcgcccttcccggtacgtcgcgtgtgtggccatcagcagcgcttcacgaatcatcgcccggtccgcacgtttgagtgaggcctcttccttcggatcaccgccggtgatcatcatcctggcagagatttccatttctcccagaatgtcgcgtttatcctcctcttcatcgccatccagatcgggcagcgagtgctcatccacactctgcagggtctgcccttcttcaaccagcttatgcgcatccgcaaagggtggcagtgtcacaccgctccccggtttgacactgattttgttcaccgaaagcccgagactttcaaagtaatcggccagcagaccaaacgagttacccgcctcggcaataaacaaccggggacgatgcacggccatcacctgtgacagagaggcacacagcgtggcagacttccctgcccccgtgggcccgaacagcaacagatgggcattctgggtacgatccagtttgttcaggggatcaaacgtcaggacatctccccctcggttaaaaaaactgaagccgggatgccctgtaccgttttcccggccggtcaccggcagaagcccagcgagatgctgtacccacatcagacgtgtgtaccactgctttctgtccatatccggatcaaagcacattggcagcgcacgcagccagctgttcagcggccccacatcaaactccggtcgcaccggctgcaggcctgcccccagcagaaccgtggtcagctccacccgtttacgtttcaggctgtccatatcaccggcccgcagaaggaaggtgatccccgcacgatagagtttatgtcggttacccagcaactccttcaccaccttcacatcctgacgtgcccggatggactccgtattctcacccacggcatttttcgacagccgggtaaaccgctcctccagggtatcctgtggctgtaccacaatggtcatgcacagcaccgttccttccggaaacgtatccatcagcgcattcaccgttttttctccccgggacatctcaccggtaatggctccgggctccggtggcgtacggagcttctccaccaccacggcacaatgtggcagatcatcaatccaccacaccccgttctccggatcggaatagggcggattaaaccacaggctttctgcaaagtccgtcatcaccggcataacatccgcatcgttctcacggggatcggctcttgaggccatccggtacaaatcctcccggctaatccaggacggtgccggattaaataaccggagtaaccagctgtgaacctgcagaccgttcatccggtgacagcgcaccccggcgctccccagtgccgacacaacgcgatcgcaaacctgattcagcatggccaccggcggcatcggatcactgttgttcttcgcgatacgacgataaatcaccatacgggttctccgctgctgtccccgccacggctgaccggtaaccagcgtgtctgtaaaaaggccttccgggcgggcaattccccgcaaatggcgttccatttcgcccagccaggcttcagtaaacgccgttccctgcgcgtgaggtttcacatagcctttcagataatcaagatacgcatccacgtcattttcatcctggcagaagaactgcaccacccagggatgcgtgtcatactcatcaaagctgtcctgcagtgcgtcctccaccatgtccctgatctgttcaagacgttcatccgtacgcccttctgtcgccgccggcgtcacgtcataaacagcccctaccgacattccgtcatccagcagcagacactgagcctcatccaggtactccacccagggaagaaaatcaataactgacggcccggcatgataaacccgggcctcctcttcctgcgtcatctgccccggacgtttcaggggctgtgccccgggcgggacaggcggaacaaaaccctgtcctgccgcctccgtttcagatggcgtggtgacattgcgacgtttaaacagtgtgaatgccattacatcgcctccgtacgctcacctggtaacgcatactgcgttctgctgtaaaaaggaaatatcgtgctgtatcccggcaccggtgacgtcccgccggcaagatgcgggaatacgtacatcaccatgtcagggtttggcagacggggaaactgctgactgatttcactttcctgcgtcctgctgtagctctggccctccttgtgtacctgctgtttctcatctgacgtcaggggccgccacagtgtctccctggcggcctgcgcatgtcgctggctcccccccgttgttttcccctgccagagttcaagcatggtctgatcgcccgccggcagaagctcctctttcgaggtggagcacccggataacagcagggcagccagggggatacacataactaaccgtaatcgtctcacaaacgtattctccctgttcagtcaagccccccgtggtcgtttgcttcacccggcagggcgaagtcataacgcacacggcggccttgctcttcataatcaatagccagttgtcgggtaatatgtaccgccagcgctttccccggaggaacataaatggcatcaaacgtctgcccgtaacgctgcctcacccagtctgccgtctcattcattccaccggacagcgccttaccaagtgcagcctgccccgcgctgccggtcagcgtggaggtgataccgttgacattgttctgcgaggtatactgcccctcactcagggcatccccggctgcaccggcggctgacagtgcaaatatcgttggcagataacttgacgcattggatttacgggtaccgctgatgcagggaataccgtcttcatcggagatccagccaatcccgccagtaccattccccttcgcctgctgattgctgttggtggtgccgttgacatccggtgacggcagcgtgcgcaccgtgccatcagcaaaaacaaaggtgatactgttcacctgcccgcgcacacaggaaagcgtccagtcaccactggccgtgccggagacaatcgccccttccacatccggcagctcaatgccgtttgccgtgaggttgtcacgcccgaccaggatcttgaacgggtaagggtccgtcacggtgccgttgatcggcacccgccccagcagggccgtcatcgcacgactgcctgtcagcgttgaattttccggcagcgtgtagaccgcctgtgtggtggctcgctgctgttcattgctgtatcccttcacctgctgctcatactcagccttctgacgactcagtgcgttgtcctcaaggaatgaggtcggaaaacgagggcctccctttgaaccactgctgctcaggggatcatcctgagactgatcggccggacttacccacatcagcccgtcagccccctgcgtaatcaccacgccactgccgccgcccgcatcaagcccgagccccggcgggatatcgctttcctggcggcgactgagcgtctctgcccggctcagttgatctttcatggcgtcaatctgcgacatcagggaatgctgctgctcctgcagtttccgctgcttctgttcgtaggttttctgcacccctgccacagcgtcattcacctgaccggacacatccgtgctccgcctgcgcagctgctcgttatccttaagaagttgcgagttctgtttctccagcgttctctgattgtcccgcacctggttcatacgggcgaccagcgtccgtaatgtgtcttccggcgtgtcaccttccaccccaagagcccgtagctcttctgacgataatccggataaggtccgggcctgctccccgcggtcagcaacattttcctgcgttttgcagcttttcatcgtgactgcaagccccaccagaacaacagcgggcaccacaaatttcaccagcgcgttggacttaatctgcatgcgtcacctccccgcccctgcgggacgttacaggctcttccacaaacgccttctccggactgcccgccgtcaccacatacagcatcgtggtatcttccggcgtaccggcagcacccagccagcgatgctggaaagtcgccgccacaaaacgcccctgaagggcccggggatcaagcacaatacgcctgcttaccgtactggtgagtttcagggccaccaccgtccggccaccggctgcccatgccgccaccggtgaaacagtcagcggctctgacggataaaccgtggtgatctgccggggaagatgtggcaccaccggtctgatccccgccaccggttcaagggtgcgcagtggtgcatacagggactgtgccgcataccgggtcaacagcaccggcaggagctcagcataacggggctccgtgcgacgggcctgagtaccattatccatccccgccttcccgttgctgctgcgacttttcacagtctgtacatcactcccggcagcacggctgaccgtactcacgtctccgtcatacacgatacgcacgggctccgtggttcccttttcccccgcagtgacatccagcaggatcatttccccgctttccacatcctgcagctgaacccgggtctgcggaaatgcactgtctgccttcaggtagaccgcaccaccggtactctggacccgcagttttccattcagcgccggagggaagcccacccgcacatttttatccgcaaaaatcacccgctcctgccccaccttcagcaggatattcagcggtatacgctcccacttcatcagttcatccgcctgtgccgtcagactcagcactgacaacgacatcatcatgacggcaggacgcagcagactgcacacaatgccggctttcattcaccacctcccttcacggcttccagacgctgtggcgtggagctgtagcagtccagcacaagaccaaacggattacgctccggatcgccctccatccgcatcactttcatcggatagcggatcagtgcccgtttgaccggctctgcatgaaaatactcatccgccaccaggtcgagacggacaagccagttgtcccgcccctccaccgtgaccgggtcacggttgtaacgtccgccgtaaccgtgctcagggatctcatacaccacacgaacacgatccagcagctctcctgcatccttacgacgacgggcatccgtctccaggatctcccggcatgacggtgtcagataggccgacagtgcatgtattttcgccggataatccacctcgccatttttcggccaggcattcagttgctgaaaaatgtagaacgcaaaggaatagaccgttgacggaggaacttcccaccacggacgcgtactgccggaacgcagatccggcggattatgaatggtcagccggtcaggggccgtcatccacccgatagtgaccataagaagaagtccgcacagcacaccgctgaacaccctcagcgtcagaatatgctgatcacgatccttcagggcatgacgaaaacggctcatgatttaccccctctgacacgggtacggcgcagggaccagccctgggcctccctgataagcccggagcgtcccactcccagcgccgcttttttctcctcaagacgctgccatagccagttatccggtttcccccgcttcagacggctgatccatgcccccccggtccagacaagaaccagcggggtcagcagggcgccagtgggtatagtcacccacccgaacaccggcacaaaaggaagtgaccacagcagaccggtgaagaacccggtcagtgcagccagccccagttccggggtggtgaaccccctgaacaccgtcggttcggcgttcagacgatcgggcagaaaacgaatggtctccataaccagctccacggtttcttacaggatgatggacgcggatttaccaagcagccagatgaccgcaaccagcagtaccacccccaccacgacaatggccccgaactgcccccagcctttcttgtcatcacggacttcagaaaaggtggtaatcgcagcctctgccactttcacaaaggcagccgcggcgatcaccagaccaatcagcacaatgccatcctggaaataacctttgatttgcccgaaaagtccgccaccaccaccggacgacggcggttcaatctgcggcagatcggccagtgccggtgtcagactacccagcaaaaacgtcaccatgaccattcccgccagacgcgccatcaggcgcagacggctgacagtaagcccttttttacgcatagatttctccttaaaaagtcacaccatgaatcaacccgcaaacatccagatgctggcaaccagcagcagaacagtgcgggcagtaaaccagataaacgcagactccctgacgtcaccgtttcgccagccagaccagacatccgacagtccccaggcagcccagagaaagagaacggcaatcagtaatcccagcgagaacagatgcagcacgttcagatccacatctccggatgccaccttaaaggccgcagcctgtgccgacgtcagtgccatcagggacgctcccgccggtattcaccggtcacggcactaccgttacgtggttgcgcccgggagggcgtgagataacggtcgatcccctcctgcatggtctgaatgtcagcctgagcacgcggatagtcgaaaaaataacgcccgtcatggggcgtggcctgaagggacgccgttctggcccgatcaagcgccgcacggacctgatcaagctggcgcatgaccgtcgccagctcatccttttcagcggcctgaacgggcagaaccagggtcacgagaagcatcatcccggcggtccccgtcagaccggccgttttccgggataatgcaggaagagaaaacatacacacctccgtcagaatcaatgggtgcgtacagcatgcgtaaggctgcgggagggatcagcgataaactctatttgcaaaactgaaaatttttacgggagaatacacgggtgtggataaaggcaaacaacccggagttcctagcatgaacgatatcatcagtataatcattcttctggcagtctatctcatcggcctgatattcattatcctgattttcaatgacatagacataacatcgaaaaagagaaagtacgaaaaaaaactgaaagaagcgataataaatggcagtttacaaaataatgatatctgtttactggccgaacgctggtctgtcagtcatgaacatatcaaaagcgcactgctgtctgttttcaatgattttcagactgataacaacttttcacatcacgtcccccgggtcagagaactgatcacatggtacgaaaaatacgccccattcacagaactccctgaggatataaaacaacagcttcaaaatataatcaatttacccgatgccagtgagtcagaagtgcagttattagcctcctcacttcatgacatttataattctcgtcagaaaaaagagaagaaggccagaagaataaactatgttctgggggcggtcagcattgccagtttctgcatcacgctgttccagagcctgttcaaataaatttattccatcctgaatgatttattcctgtttattaaaacacggcatcactaccgtttcccgttaatgacacctcattaacaattaaaagaggaaacacatcagcatggaatttctccgtaccgctcttccgttctgggccctgtttcttctgacctgggtttgtgttgtgttgcaaaatggcatctgaatcgatcatggtttggcatctaaatcgatcacggttgtggaatacgcagttgtgtattttttcatttatgaagaaccacgttgcctccgtgaatctatgacgtcgtcaaggccatcacgatgttcattgttttcgtcaacattgttgttattccggcattgtcattactcggacactgacgcgcactgaccgtaagggcgtggcttgtctgccgacaccctgccacaaaacaagttttgcatcagggtgtccggcctctgtggattataaatatttcttgaaggatgccattgtcacggtgacagccatacccagcagcatggccgccggccatatcagcagattcgggtacacggccgtcggccaggaaagatagagaatacagggaatatatatcgccggtttaatagactttttcgcatggtgataaacaaagctggattcatatgcggcaccataccggcgcagatcacgtctgcccagcccctcaaccacggccaccaggatcaccatcacgaacagtggcacggacagcacgagaataatcaccctgaccatcgtcaccaccgccacataaaccgttgccagcaggtaatcatgaagatgatatgccagccactggctcagctctccgctgaactgcgatacactccgccccgccgccgttaccgcctgctgcgactgcagccatgactgcataccactttccacaaacagccactgatacgccacggaaatccagcccggtaccgtcactgacggcgtggacagcagcaggctgcgcgtgaactccgtcgacagccagcccagctctgtattcatgacggcacgactgtgtgccgccccctcatcaggccagaaaaacgtcatacctgcatactcaatcagcagactcagtaacagtgaggagaggagcagccccaccagagcccatggccagccccacaccagattgtacagcaacccatgctgacggggagggcgggactgcggactgcgttctgcatcacgacgtgcttccgccatggtcacctccctcctccgtcgctatcgcctgtactaaaggtggagcattccaccatccttcaccggagtgataattctgtcgcatcgcctccgccacccgggaaatactctccggcatcagcacatcatccgtatcacctgccggcagcggcatccggatcttccataactgtccaccttccagcagggcaaatgcctgtcccttgggcagcgtgacaatatctgcgggctccagcagggggactttcaccgtcccgacgcgatcctgggtactggaggtgaaatcctgaccggctgacacatctgccgtatcctgatgaccggagaccagcgtcttcgtgtaaatctccacctggggcagttgtgtggtcagcaattccgccgtccggttctccctgacgcgcagcatgatcatgttgttaaagttcccctgaacctgcgccgttttggccgcattaccaatacgcgcttcaatatccgatgacgtctgggtgtacgcggtcacctgcattccggcgccgccccccttgttgatgagcggaatgaattcatcgcccatcagttcgttaaactcatcacagtgcaggttcaccacatttttacccgccccgccagccggcagaccggcatgcataccgtgtttatatatatgccctgccacactcaccaggtccgcaaacatcgaatttcccacggcactggccacctcactgtcactgagcgcatcgaggccgatataaaccaccgcctttttgcgaatcacctgttcccagtcaaaaatggggcgcgcatctctcatatccatatagtccggcgccagcagctctgcaatcctgccggtggtgagtttttccagtaacggcagcagggaagccacgattttgtcaaaatacgtacggtcataacggacagcactacgaagtccatccagaatcggatcgtatatttttttaccgtcctcactgctcagtgccatttcaatcgaccagatccgcaccgcatccggctggttctgcatggtcctgggcacatcttcctcgctgagaacactctggttattcgcgataatctgctccagtccgggcagacgctcacggatcaccttccccgcatagcgaatgtagaggtcagcgatgttgttcacataccgcataatcagcatatagtccggacgctcaccgagggccaccagggcgcgggcgatgatattgacaaagcgccaggaaaactcccggaaagccgccgaattaccttcaccggacaactgaccagcaacacgggaagccacttccgatacacgaccaaagcgtcccaccgcattgtaacgggctgaaatttcaggccagccaaggtgaaagatatacaactcatccccccgcccggcccggtgcgcttcagcccagacccgcagcagcagatctgcatcccccttgggatcaaaaacgatggtcacttctccccgccggatatcctgggtgaccagcaactctgccagacgggttttcccgacacgggtggtgccatagacaatggtgtgccccacacgttcacccagtgccagcgtcacatcctgctcatccggctcaataccatgcagggcaggatttcctcccaccggcggcaggggacggacgggattcagcggcgagtcacgacgaataagctgcccaatccagggaagactgtgctccgttttcatttcaagccagcgcgctgtccggtacagactgcccggctgaagatagtgcgcaacctccggtcgcagcgtgtcctgaaggcgctgggtgtgcttctgtgtccagcgaaatccccgccccagaaacagtcgctgacggctgacaggaatttgccgcgtgctcatcacatagcggggtaaccgacgcagattgcgtcggtagcggatgattttcatgccctggcggaaacggacagccgccagaacgccaaatccggcagctgtgacataactgaccgaaggcgcaagcgctaccgcccagggggctgtcacacagataccggccgccgttgccgcaaccacggccgtattgaactccacagctggcctcagtaacgcctcaataacataacggttactcatgtccgcgtcctcgctgtaaaaggcgcagccaccatgagcgggggatatctgtctccggtgacgctgacaacgcctcagctctgttctgtaatttcctcacctcccgccatgcgtcttctgcactcagtaacaataccttatacaccgcagacgcatgtccgccagcccgtccgtcatccactgtcaactgagcttctgtgctgaaacggtccactttccagcaggccaggtcttcacgggaaacacactgccgccgggtctgcagacgaagatacacaccatgccgggagagaacatcagccaggttgtgaatttcccgacaggcagaccagaacgcccggtctgcgtgataaatgctctgggccacgttgtgaagctgtgtgcgctcctctccctgcaggtgaaacagaaagcgggccagacaactgcggtgattaccatcagcactgacataccagtgaatgccatccgtgctgacaaaactcatcccggcatgcagttgttctgcctgcgtgtaataccccgggttcttctccaccaacgggatattgatatccatacgcttaccgcgctccagcaactccagccagctcattccggcatactgtggatggtcagttcccacgatgcggaacacattgatgctgccctgccccgtccagtagtgttccgtaataaaatccgacattgccgcaaactctgccgcattccatgcccgtaaaggttcattcgcccattgcggcatattcctctgcacctgttcagtaaatgaaacgttcatccccgctctcctgtcatcttcgcttttctccggtgagctcaccggtcagtaatcgcccgttcaacagtttcagcagacgctgtccgctgatcagttcaatatccggccacagcgaaagccgtgcccggctggccggtcccgtacgcccggtgtgaacaaaaaatccacgacaaccttcacgacgcagtaattcaccaaaatcatcgatatgtgacggtcggatggtgcggccatagcgtttggcctgaatcagccaccgctcgccgtcaatcagcacctgtccgtccagccctccgtcgccgctgtagcgggaattgcggataacccgcattccccggcgttcaaacgccagaagcagcagttcttcaaacacatacgggttaatttttcgcaggtatttcacgcctgcaccgccctccggcagcgacgacagttgcgccatcacacgctcagccttgcgccggtaatggcggtgacgccactcactggcgcgttcacgacgccggcggcgaccacacaggacggggaaaagcaggaacaacacggtcaggacacacagcagaacgccgtacggtatcttatccggcacaatatccgtcatttgccgcagcatcacggtgtcaccaccccggatattccgctgtccgttatcagtaccggccagtgattcagctgcagacggcgtgccagcgctgaccccgatgatggcaccatcatcacgccgggcgccagctcacgcagcgttttcaggctgttttcatccgccacgctgacaaccatgccgacagcctgccgctcacggagagcggccgcattcgccttcagccactgacgggaaagcgcatcatctcccaccagaaacagcgccccgatccccggcaactgcagtggtcgcggcgtcacctcacccggcgtcatttccggcgtggtcacgggcagcaccaacgtctctccctgcgccggcagaggcgccgtaaccgggggaggcgtactgctcccatcctgtcggttgattgcctcataaaacacggaggcatcactgcctccaaggtccgcaataaccctgagttccgcgccagcctgagacgcgcacagcagcaggggccacactgccgtcattacatatcgtttcacaggtatcactcccggggttctgtccagatataacggggatgcatggcggtcaggccgtcatgctgctctgcggtcttcaccgcatcacgatgaagacgctcaatatgttgtctgaccactgcggtgtagcgtactgccggagcaccacctgccggatgatgataacaaccggccgcctgcagccagctgacaggatgacgacgacggcattcactcaggatggtcgccgcggtgttcagactgatgtacggatcaaatgccgcccatgtggaggagaaacggtgcccgttccagcccagattgacctgagcaattcccacgtcaatccgccgggccggataccgtgtcagaaaaacctgaagtgcctgccaggcttccaggcgactggcatagcggtagcccttaccagccacattgatggtccacggccagggacgtgcaacggacgggaggcggaaatccgcatcccgttttttcatcacaccggcaatcgcagagggcgccatcaccgtctctgtcagagagacggcatagagcacttctgcaggcacaccatgcacggcagccacgcgcacatacccctcagggatatcatgctcccccgcccggcagaaactgctgacagccatgctcaacagcgccattgtcagaaggctgccacgcgccatccgtccgctccctgctgcagtacaaccggcattctgccttcaccaaaacgcagccagcgaccggcatcatgattcagggtaatatggcggcttcgcacccggtccacagggatatcgtgctccagtgcccactgccgcagcagattgtcactgccctgactgtcaaccaggtaaatatccacctgccgccccgaagacaacactgatgccagtcgtgcatcacaggttccacagtctttcgctttcacaaacaacgccagccgcccgccgttgtcgtttagcagcccgccccctttccccaggctgaccggcataacgcccggataaaggcgtttccaggccgcattgacttcccgctgaaatgccagttccttctcagtccgctcatattcggccttcacccatttttcagccagctgccggcgttccgcatccgtccgtgcttcaatccccagcaccgtcagcggatccagaccgggggactgaatcccccgcggtccctccatcagagcccggtatcgacggtaatcctcctcagtgactccccactgagcggcctgttgctgcagcgcctgtgtggtggtactgacctgcgaagaggcctgcgtgcgtgtgccctcaggcgcactctcccgtacggcagccaccgtctgcagggaaatgagcagcatgagcaccggtgacagattcttcattttcatttcatcactccaccatgacccggacctgacgtccgttcacccggaacgaggcttctccccgtccggcacgctcaagcatccagccggccgtgctctccccttcacccagcagcgtcacatctgaaagacgggtaaatccacggggagccaccgcagcatatgtgcgtccgccacgctgctccgtgcctgtcagcacaaacggtgcgctgcggctgataactgaaacgccggaagagccatttttctggcgtggcgtgaccgccggtgtgctcttcaccgtgcccgttcctttcgcagatgacggtgataccggggtgaatggcgccttctccagcttctccagtcgccggtcatacgcacgaagcgtttctccctgctgcgccagcgtggcctgcagtgatgccaggctggcggccatctgaccagtgcgtgcatgctcttcctccgtcagtacaggtcgttgctccagcaatgtcagtcgctccgtcacgcttttcagctgtttttcggtttcagccagccgggacctgagcggttccaactcacttcccgacaacgcgagagcatctgaatacgttttcatttgcccctccagtgcggcaatgcgttcatcctgctccccgctgtaacgatagaggccacaaaccgccagaatggtcgcaaccagaacggtcagtacaaatcccacggaaagcatgggtgacacacaggtccacccatcaagaggagatgaatgcactgacggtaatgtcttctgttttttttcactcattttttaagccccgctcctgcgcccctgacaccggccggtaccggcgccagctggcccggcggcaactgataaccttcccgcaggctgtgacagacaacccgctgcacatcatcaacttcaagttgccacgccggaccggccatcatctgcagggcggtacgcaacctgagcggccccgtctgatactgcactgccggcaacgcctgacgataaagcaccccgttggccggtccggtggcacagagcgtgtagcccgactgtttcagggcataacgcatcgcatctgccaccgtcggcttcagggatgacggaatacggatgtcaatcacctgggaaaggggatcccgctgtaccgcatccggattagtgttaaccagcagatagcggtcataacgcaccacctcgggcacggtcgtccccgcgtacatatcagggctggccggacggacattattgctgaccgtcaccgacggtaccggaacagccgcatcccgctgcagcagtttttgctgcccctgacagccagtcagaagtacgcaggcggacagcacggaaagaagaagggatgttttcatcatcaggaagttacctctgcggtgaagtgataaagtcagaggtcaatttgcagaagaagtccagatcggctcaatgaacaactgatttccggttgacaaaaaaaacgcctgcacaaggcaggcgtggtgtaaaaagggaacagagtattccggttattcagtcctggttgagcgcaccattacgctgcaccgggacgtaatccagagcctgcagcaactgctcatctgtcagatccagaaaatctttgatttcctccagagattttcccctttgtctcatcatgagcactaatctggagcgctcttcagcacgacctttctccagacctctctcttccagttgctctgctattgaagtggtcaacaaaaactggccaccgcgttagagtttttccagtatcgattttccgattcgtttgggggtaacccaccattatattcgtgcggtcttagtgcgctgtaatatccaacgatatagtccgttatggcgtgagctgcctcgctgaagcttacgtaacccaccaccggcatccattcgttcttcagactcctgaagaagcgttccattgggctgttatcccagcagtttccgcgccggctcatactctgcgtgatctggtatcgccacaataactgccggaactgcctgctcgtataatgactaccctgatcgctgtggaacatcaccccgccgggtttaccacgggtttcccatgccatttccagcgctttcatggtgagcctgctgtccggcgagaacgacatggcccagcccactggttttcttgcgaacaggtcgagaacaacggcgaggtacgcccagcgcttacccgtccagagtagagtaagaggcagggcgtagtcggactatttccctgcctctcctccccgaaccggacgtgcacctttcagcgcatccggctctccatttaaatgctggcgaacgccattgccacttctgtaaagcgcgatgtatacgtgtttctggtctccgtcctcagatagggattaccttcgggtagccgccagcggaacagcttcttgccttgccccaccaaccggtacagtatttcgccgctgagcttgccgtgattggttttaccaaataaaacccacgttttgctctgacccggtttcggtgatttacaccaccacctcatcagggaagcgatacctgtacggtatttgctggccagccagtgagccagcttccagaacacgacacggtcgatataactgaagactttggccttaaaatcaacgaactgatagaacatggcccagcctttcagttttcggttgagttgttcagccatatcgactttgctttcactgtagttgcctgataacagtgctgtcagcgatgcggcgaagtttctggctttctcctgcgggatcgttgagaccactcgcatctcgccataacgactgcgtttgcgaatgatcctgtgccccagaaagataaagccgtcattaacatgggtgattttagtcttatccatgttcagcctgagtttcagactgccttcgagcacaccccgacactcctccctgatggcttccgcctgtgctttggtgcctttgacgatgaggacaaaatcatcggcatagcggcagtacgccaccgcgggtttccactgccagttttctctgaccgccgtacttcggccccgttggatactgttattccagtaccacagatcttttctggctttcccgctcaggtagcgctcatgcaggtattgatcgaactcattcagcatgatgttcgataatagcggcgatataacaccgccctgtggcacaccttcactggccgcccgaaagagaccgacatcgatatgtcccgccttgatggttttccacagcagagtcatgaaacgtgcgtcactgatcctgcggcgtacagccttcatcagcagtcgatgatgtacggtgtcgaagtaactggacaggtcgccttcaatcacccagcgtccccgggtttcaccgcagtctgtgagctgtaatttcaccgtgcggatcgcgtggtggacactgcgctcaggccggaagccatatgagagcgtatgaaaatcactctcccatatcggctccatcgccatcagcatggcccgctgaacaatacgatcccgcaacgcggggatacccagtggtcgcagtttgccgttgcttttagggatgtaaacccgtctggcgggcaagggctggtagtggcctgagagtaattcatccctgaggatttgcagctcaacagccagtctggcctgtagcattgttttgttcacgccatcaacgccgggggtatgcgccccctttgatgaaagcgtgatccgcgccgcttcagccagccattctggttgtgttatcagacgcagcagccgttgaatccgtagggacggatcggtggctgcccatgtggcaagcttgcgttgcatttcgctgattatcaaaggtcttcacctcgttaggtcagttaattcacgtcgcaaacacattcaaactgcttcccttcgccatgtaatgggctttccccatcgcggactactacggaagctccgccagccagcgcgtcatcggagccatgcccccttaacatccgtcgctgactttccccggtttacctgcctggactcaggcatactgaggaggctgcccgtcgcactctttatccttgcttgccgcaagttggcagaagtcagcaacgcaagcgtgatagacgctgctgccccggtgtttcgcatacatgtcaaaacaccttcgaccggcagtgcttacgtatcactgccagttcctcctgcacggcctgtcagatcacgtaggccgtggtgacgttttcaacccacagaggcggattaacgggttcatgttcttcagcctttcagtacttaaccttgaggatcatctcggcttagtgatctcgcctcaatccccgttgtcagcgggttacatcaccctgcgggcatgccgcaggtcactgccgctcaggttctccaccgtcacacccggtgggattgttgggtttctcatcgtgagttaccggttcaatattccagacagactcgcggttcatttaagcatccatgcccgccctgaactccgggcacactataggtcacatcaccgcaccacacctgatttggctcggtcacggcgaactgccgttcaaggtagttagggatagcaatatgttcatgaccaccacgtttataccggtgagtcggctgctgacagctgaccagccccagctctttcatgagcctgccagcaagccagcgtcccatctggtagcctctccgggttgccattgtggcaatgcttcttgctccggccgaaccgtggctgatgccatgtagctcaagtacctgactgcgtaatacagcccgtctgccgtctggtttttcaggacggtttttccagtatctgtagctgctgcgatgaaccccgaacacatggcagagtgtggccacaggataatgcgctctgagtttcccgattatcgagaactgttcagggagtctgacatcaagagcgcggtagccttttttaatatttcattctccatttcaatgcgttgtagctttttcctcagctcacgtatttcgatttgttctggtgttatcggagaggcttttggtgttttgccctgacgctcatcacgcagttgtttgacccatcttgtcattgtggaaaggccaacatccatagctttggcggcatctgccaccgtgtagttctggtcaacaaccagttgagcggattcgcgtttaaactctgcgctgaaatttctttttttcattggagcacctgtgttgttctgaggtgagcatatcacctctgttcaggtggccaaattcagtgtgccacttcatatcgtcataatcccccccttgtggctgggatagtgtgtggatactgcttcagaaagttcagcaaaatccatctggtaactttccataagataagtcagcacgatattctggtgaacgctgctgccatacttatccgtcagtgtgattgatttaccagtcagctcaatatctgtcactgccagaaactaccaaaaaaacgcctgcacaaagcaggcgtggagtaaaaagggaacagagtcttccggttattcagtcctgatttaacgcaccattacgctgcaccgggacgtaatccagggcctgcagcaactgctcatctgtcagatccagaaaatctttgatttcctccagagattttcccctttgtctcatcatgagcactaatctggagcgctcttcagcacgacctttctccagacctttctccagacctttcttcagacctctctcttccagttgctctgctatcgtcataatcacccccttgtggctgggatagtgtgtggatactgcttcagaaagttcagcaaaatccatctggtaaagttcaagcagataagtgagcaccgtgttcaggtgaacgctgctgccatacttatccgtcagtgtgatagatttaccaatcagctcaatcacatcaccactggtgccggacttcatcgtgaacatcagcgccgccatccggtgatagtgttcaatttcatcatcggtaagcgtgctgacatccaccaggctgaatggcttttgctcgccataaatctcgcgtccgtacgccgggtcatccagacaatccacccagttcatcggatacggatatggccgctttgcaccatgataaaacagcaccgggatcactactggcgcacacttatgctcttcaatatgctgctccatcaccgccaggatataacgcatcatgcgcagtgggataaatttatccggcgaactctggtgctctattaaagtataaatgtacccgtccttcccgtcatttgtcttcatgctgagcaaaacatcgcaggcagactggcgtaaactttctgccacaaacgtcgtgggttcaagttctattgtatcaagattacagcgggatttctgatacggtgtcaatacctgttcaagaaagtccctcgcggctgcagggtccttcagtgtcttcctgaacgccgcatcatgtatcaggctggttttattaactttttcactcacggaacctccagataaaaaagtggggcgtaacgccccatggttgatgttacatggcatgaataattcgtcgttccatgccatacccgagccccataaagggaatatcatcgtcaaagtccattggtggtgcaccattacccgttgatgttgtctggggtgcacgaccagcctgtccggccgtcttcggcggctgtccccagcccccttgtgcaggtgcagaagcaccattaccggcagtgccctgctgacgcagcgaacccagcatctgcatgacaccattcactcccacaacaacctcagttgaataacggtccacaccgttctgctggtcaaaccacttacgggttttcagctgaccttcgatataaaccttagagcccttacgaaggtactctccggcgatttctgccagttttccataaataacaatgcggtgccattcggtcacttccttcatttcaccgctctgtttatccttccaggtatcactggtcgccagtgacaaattcaccactgcaccaccaccgttaggaaagtacctgacctccggatcctgtcccagatgcccaagcaggatgactttgtttacaccacgcgaagccatactcccccctcattaccagccacaacgctgtctccaggtgccatttttcagcgcctgctcagcctgatcatgttttttgaaatactcttcagattcacgggacaccggccccacagaacactgagtgccaatataatatccacgcgtacttttgagaatttccaggggtaatgtatagccagccgctgctgcaagaatgccgttttgacggttcatatgtttttgacggttcatatgtgtttccttaaagtttgcaaaaacgataagaaaacagacctccctgatggtggtctgttttcatcatcagggaggctgaggaaaatacgatcagaaagagttttctgcgtattgacgtttagttgtgccattttgcggtggcagggactccgctttttcagccttatagacctgctcctggcctattttaatccagtccaccttgatcaggcgggctttcagactgacgcgctgctcaccggcatgctctcccttgttcagggtgaagatatcggtggccaggttgcttaacgcaaagccaagcaaaaccttacggtcctcatccactgctttctggcagcgagagatcagggtggttgcatctttaccaacaaccgtaacatcaaaacgcgtataggacggattgtccgttggtccactcagtgcgttaatcacgcagcaaaggaacgagccattctgatggttaacctgacgcacattactgaggtaccccagactaaacatccccccgctaacaaaacacagttcagttcacataacatccctgttatcccacacatatctgctggccgaacgacgccagtgcgcgtacggaggcaagagcagccctgcacatggcagcgcttgtggtaacctggtttaatccggtgataaaggcattttacatgcatctgtcagcagccggaaaaaccaaaaaagtggcgctggttgactgtatgcgtaaattgctgaccatcctgaacgcaatgctcagaaagaacgaagagtgaaatgaatcgtagcatcatgttgctccataatttttacgttcaagacagttgattatcggcgcatatgactcaaaaagagcctgatgattgcctcttttccataggctctttatctgaagtgaaggaaggcccggaagaaagcactcgctggcatacgtgactccagctcaaccggagataatcaccactgttatttttctatttaataataatctcctgaaaaacagatatagcaaaaatacaatccggccagatttaattccgcattcattaccagaaataatcaacaccacaactatcatatcattcaatagtcaccgctaaaattttattattttcttcttctttacatagaaattgtcaacttgtttattatgccactcttaaatagttaatcacaaaacaacatcaccattatttacgtgttttatttattaataacatggtcatacgttctttttttacaaggaaataatcaattgataaattgttttttggtttaatagtcaagtaggaaacattttaataaatgataaaaatcctaaattccttgttcataatgtaggggtgtgttaaataggtgggcaaaatttggttccccttctcgcctgtaatattgcagcatcttcgcacctccatgagacattgcgacttaataagaaggtgataagtcctgcatataagcagggactgaccatggttttatattcattaaaaattttgttacaacccattgatttagcataaataaattatagtgggttcgggtttgttgtgactgtggcattatttccgtgcaaaggagctgatatgtctgaaagacatttacctgatgaccagagcagtactatcgatccatatctaattacctctgttcgccagactctggcagaacaaggcgcagcattacaaaacttgtctaaacaactggattccgggcagtaccagcgtgtccttaatttgataatgaactgtaaagggcacgttattctttcgggaatgggtaaatcagggcatgtcggtcgtaaaatgtcagcgacgctggcctctacgggtacgcctagtttctttattcatcctgcagaagctttccatggcgatctgggcatgattacgccttacgatcttctgatccttatttctgccagcggtgaa
